United States Patent 8,137,673 (NUCLEIC ACIDS AND PROTEINS FROM STREPTOCOCCUS GROUPS A & B) - sequence listing, part 4

SEQ ID NO: 10967 - DNA, 2160266 bp, Streptococcus agalactiae
gttcatttagaaatagttgatttcaaatataaatgtaacaatgacgtaatataatttcgtgaattttttggtaaaatatttaatgtcttatcgtaaaggagtagtttaataaaaatgaaaaaaagaatattatcagcagtccttgtgagtggagtaactcttggaactgctgccgtaacagtaaacgctgatgactttgactcgaaaattgctgctactgattcagtaatcaatactttatcagggcaacaagcagcagcacaaaaccaggtgactgctattaaaggacaagttggtgctttagagtctcaacaatcagaattagaagcgcaaaatgctcaacttgaggctgtatctcagcagttaggtcaagagattcaaactctttctaataaaattgttgcacgtaacgaatctttgaaaaagcaagttcgtagtgctcaaaagggtaacttgactaactatattaatactattttaaattcgaaatcagtatctgatgctgttaatcgtgttgttgctattcgtgaggttgtttcagctaatgaaaagatgttagcacaacaagaggctgacaaagcggccttagaagctaaacaaattgaaaatcaaaatgctataaatactgtagcagctaacaagcaagctatcgaaaataataaagcagccttagcaacacaaagagcacaattagaagcagctcaattagagttatctgctcaattgactacagtccaaaatgaaaaagcatctttaattcaggcaaaagcacaagctgaggaagctgcgcgtaaggcagctgaagcacaagcagcagctgaagcgaaagcacaagctgaagcgaaagcacaagctgagtctgtagcaaaagcacaggcagcagcacaagttgagtctgccacagctcctactgaaacagttcaaacacaaccgagaactgaaataaagccttctaatcttacggctacttcttcggcaactactgttgctacaactacagctacagctactaatgagccaaaagttactcaaccttctgtagtaactaaagcagttgaagcacctaaagcagttgtttcttcaacacctagagcggtatcaaaacctgttgtcagaagttatgattcaagtaacacatacccaatgggacaatgtacttggggagctaagtcaatggcttcttgggttggtaactattggggaaatgctaatcagtggggtgctagtgcacgtgcagctggttattctgtaggaactacccctcgtgttggtgcagtagctgtttggccatatgatggtggtggttacgggcacgttgcagtagtaacgtcagtggctaacaattcatctatccaagttatggaatcaaactatgctggaaatatgagtattggcaattaccgtggttcatttaaccctagtgcttctggctctgtttactatatttacccaaattaatgaatactaaggagatctttcgtggtctcctttttgtttattaattaggtatggtttattttggattgaaaaattgtgtaaaaagcgttaaaatggtataggactaaagttttggaggaaatcatgtcttattctaatttaaaattgtttgcactgtcatcaaacaaagaactagcgaaaaaagtgtctcagacgattggaattccgctaggtcaatcgacagttcgccaattttctgatggtgagattcaagttaatattgaagagtctattcgtggccatcatgtttttattttacaatcaacaagctcaccagttaatgataatttgatggaaattttaattatggttgacgctttaaagcgtgctagtgcggagtctgttagtgtggtaatgccttactatgggtatgctcgtcaagatcgcaaggcacgttctcgtgaacctattacttcgaaactcgttgcgaacatgctagaagttgctggtgttgatcgtcttttaacagttgatttacatgcagctcaaattcagggattctttgatattcccgttgatcaccttatgggggctccccttattgcagattactttgatcgtcagggattggttggtgatgatgttgttgtcgttagtcctgatcatggtggcgtaacacgtgcacgtaagctggcacagtgtttaaagacaccgattgctatcattgataagcgccgtagtgttactaaaatgaatacatctgaagtaatgaatattattggtaatatcaaaggtaaaaaatgtattttaattgatgatatgattgatactgcaggtactatttgccatgctgcagacgctttagctgaagcaggggcaacagcggtttatgcttcatgtactcaccctgttttatcagggccggctttggataatattcaaaattcagctattgaaaaattaattgtgttagatacgatttacctccctgaagaacgtttgattgataagattgaacaaatttcaattgcggaattgattggtgaagctattatccgtattcacgagaaacgtcctttatcaccattatttgaaatgaataaactaaaatgacaaaaaacctgttattaacaggttttttatcatttaatgacggaaaactggacacaaattatttttcttgtataattaaatatattatttcttatcaggaggttatgatgacattagagaaacgatttaataagtacttagatagaatagaggtctccttaattcgtcagtttgatcaatctatttcagatatacctggaatggtaaaattaactcttggagaaccagattttaccactcctgatcatgttaaagaagcagctaaatcagctattgatgcgaatcaatcgtattacactggtatgagcggtttattagctctaaggcaagctgctgcagattttgcaaaggataaatataatcttacttataatcctgattgtgagatcttggttacgataggtgccacagaagctctgtctgcatctcttatagctattttagaagctggtgatgttgttctattacctgcccccgcttatccaggatatgagccaatagttaaccttgtaggagctgatatcgtagaaattgatactagagaaaatgactttagactaactcctgaaatgttagaaacggctattatccaacaaggtgaaaaattaaaggctgttttacttaattatcctactaaccctacaggtattacctattcaaggcaagaaattgctgcattagctgaagtccttaaaaaatatgatatttttgttattagtgatgaagtttattctgagttaacttacactggtcagcagcatgtttcaattgcagaatatttacctaaccaaactatcttaattaatggcttatcaaaatcacatgctatgactggttggagagttggattggtgtatgctcctgaagcatttattgctcaaatcattaaaagtcatcaatacatggtgacagctgctagtactatttcgcaatttgctggggtagaagccttatctgtgggtaaaaatgatacgttacctatgcgtcaaggatatattaaacgtagagattatatcattgataaaatgtctaaacttggtttcaaaataattaaaccgagtggcgctttttatatctttgctaaaatacctgatagctatccacaggattctttcaagttttgtcaggattttgcttatcaacaagctgtagctattattccaggagtggcttttggtaaatatggtgaaggatatatacgtctttcttatgctgctagtatggaagttattgaaacagcaatggctagattgaaagtttttatggaatcatatgagggttagtcaaacatacggtctcgttttgtataatcgtaattatcgtgaagatgataaattagttaaaatctttacggagactgaggggaaaaggatgttttttgtaaagcatgcttcaaagtcaaaattcaatgctgtgctccaacctttgactattgctcattttattttaaaaattaatgataatggtctttcttatattgatgattataaagaagttttagcatttcaagaaaccaattcagacttgtttaagttgtcatatgcgagttatattacttctttggctgatgtggctattagtgataatgtagcggatgctcaattatttattttcctaaagaaaacgttagaattgattgaggacggtttagattatgagattctaacgaatatttttgaagtacaactactagagaggttcggtgttgctttaaattttcatgattgtgttttttgtcatagggtaggattaccttttgatttttcacacaaatattctggattattatgtccaaaccattattataaagacgagagaagaaaccacctagatcctaatatgctgtacttaatcaatcgttttcagtcaattcaatttgatgatttacaaacaatttctgtgaaacctgagatgaaacttaaaattcgtcaatttttggacatgatttacgatgaatatgtagggattcatcttaaaagtaaaaaatttattgatgatttgtctagttggggaagtattatgaaatcagattaagttgtaaagaggaacatgacattagtgtcatgttcttttttttaatattaggataaactaatatggaattaatttttaggatatttgagatgaaaaaaacattatacattaccaataaactcttttttgctaactggtttgtgccagttattggtgcagttctaattcaagttatcggcatcattgtaagtagacgccttgtagtaaaattgctacctgatgattataaattcaatttatacattgcgcttttactatttgttcctattttggcaagtattttactatttttaatctattttcaaaaaagggattttacttccttgggatttactaaagataataatgttttaacaacgatctcaggatttattactggtagtttactgatgttttttatttatatttgccactggttatcaggttttgtggaaatttcttccagcaattccttttcttttggaccttttttctttttatttcttgcatactttatccaaagcttgacagaggaaattttatttagaggatatgttatgacaacagttaccaaatttaaaggtagttttgcaggtgttttatgtaattctatgttgttttcttttatccactttagaaactatggtatcacagcaatagcactttttaatttatttttacttggtattattttttctattctttttaatatgaccaaaaatattctttttgttacaggagttcatactacatggaattttactatgggatgtgtattaggtaataaggttagtgggggggattctcctgtttctctttttagaattactgaaaattctagctttgctctttggaatggtggggattttggttttgaagggggagtactatgttctttgatattagtaggttgtttagcatacttttctttggaaagcgtgagagtatctgttagatattagctattattgccttcttgtgaaaaaaataaagaaacgtgctataatatagccactaagtttttatgaggagttcattcatgaagaaaattgctatagatgctatgggtggagattacgctcccaaagctattgtagagggtgttaatcaagctatttcagattttagtgatattgaagtacaactctatggcgatcagaaaaaaattgagaaatatttaacagtaacggagcgagttagtattattcatactgaagaaaaaattaattctgatgatgagcctgctaaagctgttcgtcgtaaaaaacagtcttcgatggtcttaggagctaaggcagtcaaagatggtgttgcacaggcctttatttctgcagggaatacaggagctttattagctgctggtttgtttgtagtaggacgtataaaaggtgttgatcgaccaggcttaatgtcaactatgcctacgttagatggtgtgggttttgatatgcttgatttaggagctaatgcagaaaacacagcttctcatcttcatcaatatgctattttagggtcgttttatgcaaaaaatgtccgtggtattgaagttcctcgtgtaggtctcttaaataacggaacggaagaaacaaaaggcgattctcttcataaagaagcttatgaactgttagcagcagagccttctattaattttattggaaatattgaagcacgtgatttgatgtctagtgtagcagatgttgttgtcactgatggttttactggaaatgctgttctaaagacaatggaaggtacagctatgagtattatgggaagcctaaaatcttcaattaaatcaggtggcgtgaaagctaaattaggagcacttctattaaaagatagcctatatcagctaaaagatagtatggactattcaagcgcgggtggagcggttctttttggtttaaaagctccaatagtaaaatgccatggatcaagtgattctaaagctgtttattctactttgaagcaagttcgtacaatgttggaaactcaagtagttgatcaattagttgatgcctttacagatgaataggagtgaactcatgtcaagagatgaagtttttgaaaagatgctggaattattaaggcagcaacttggtgacccacagttagatatcacaccagagtcatcgttacatgatgatttagcaattgactctatcgctttaacagagtttattatcaatttggaagatgtgtttcatctagagattccagatgaggctgtcgaacacatgtcaagcgtccaacaactattagattatatcattgaacataagtaataataaaaaggaagaaaatacgaacgtttcttcttttttttgattttaaataaagtttttgttgtattagataatgttgtgtgttagaataactcttaaaataagagaaaggcgaataatcaagtgactaaccagcttatttatacaggaaaagcgaaagatatttatagtacaaaagatgaaaatgtgattagaacggtctataaagaccaagctactatgttgaatggagctcgtaaggagactattgatggcaagggagcactaaataatcagatttcatctcttatttttgagaaattaaatatggctggtgtggtgacacattatattgagcaaatttcaaaaaacgaacaattgaataaaaaagttgatattattccacttgaggtggtgctacggaatgtgacagcaggctcattttcaaaacgttttggagtggaagaaggacacgttcttgaaacgccaatcgtggaattttactacaaaaatgataatctgaatgatccttttatcaatgatgagcatgtgaagtttttgggtattgttaatgatgaggagattgcttatctgaaaggagagactcgccatattaatgaactcttgaaagattggtttgctcagattgggcttaacttgattgacttcaagttggagttcggatttgacaaggatggcaaaatcatcttggctgatgagttctcacctgacaactgccgtctctgggatgctgatggtaatcatatggacaaggatgtttttcgtagggatcttggtagcttgaccgatgtctatcaagttgtacttgagaagttgatagcattgtaattagaagaggaaggaattgaatccgttcgggaaactcagaaaaaagattgggcttactgaaatctcaatttcagacgtcctcctattttcgagtcgctcccttgtcggacttggtatcttatatgaataaacgtatttttgttgagaaaaaggctgactttggcattaaatcggctagtcttgtgaaagagttgacgcataatctacaactggcttctttgaaggatttgcgtatcgtgcaggtctatgatgtcttcaatttggctgaggatttgctggcgcgtgctgagaagcatattttctctgagcaggtgacagaccgtcttttgacagaagctgaaatcactgcggagcttgataaggttgccttctttgccattgaggcgcttcctggtcaatttgaccaacgtgctgctagttcgcaagaagctttgctattgcttggaagtgacagtcaggtcaaggtcaatacagctcagctttacttggtcaataaggatattgcagaagcagagcttgaagccgttaagaactatcttttgaatcccgttgattcacgtttcaaggatattaccttgccacttgaagtgcaggctttctctgtgtctgataagacaatctctaatcttgatttcttcgaaacttatcaggctgacgattttgcagcctataaggcagagcagggattggctatggaggtcgatgaccttctcttcatccaagattatttcaaatcaatcgggcgtgtgccaactgagactgagttgaaagttttggatacgtattggtcagaccactgccgtcacacaacctttgaaactgaattgaaaaacattgatttttcggcctctaaattccaaaaacaattgcaggcgacttatgacaaatacattgccatgcgtgatgagcttggtcgttctgaaaagccgcagacacttatggatatggcgactatctttggtcgttatgagcgtgccaatggtcgtctggacgatatggaagtctcagatgaaatcaatgcctgctcagttgaaattgaagtagatgttgatggtgtgaaagagccttggctcctcatgtttaagaacgagactcacaaccacccaacagaaattgagccatttggtggagcggcgacttgtatcggtggtgccattcgtgacccattgtcaggacgttcatacgtttatcaggctatgcgtatttcaggcgcaggagatatcacgactccgattgcggaaacacgtgctggtaaattgccacaacaggttatttctaagactgcggcgcacggctattcttcatatggtaaccaaattgggcttgcgacaacttatgtgcgtgagtacttccaccctggcttcgtagctaaacgcatggagcttggagctgtggttggtgctgcacctaaggaaaatgtggttcgtgaaaaaccagaggcaggcgatgtggttgtcttgctcggtggtaaaacaggtcgtgacggtgtcggcggtgcgacaggttcatctaaggttcaaacggttgaatctgtggaaacagctggcgcagaggtacaaaaagggaatgccatcgaagaacgtaagattcaacgccttttccgtgatggtaatgtcactcgcctaatcaagaaatcaaatgacttcggtgcaggtggtgtctgtgttgccatcggtgaattagctgatggtcttgaaatcgatttggacaaggtgccacttaaataccaaggtcttaatggtactgaaattgctatctcagaatctcaagaaaggatgtcagttgttgttggtccaagtgatgtggatgccttcatcgcagcctgtaacaaggaaaatatcgatgcagttgttgttgcgacagttactgaaaaaccaaatcttgtcatgacttggaatggtgaaacaattgttgatttggaacgctgtttccttgataccaacggtgttcgtgtcgtagttgatgccaaagtcgttgacaaggacttaacagttccagaagcgcgcacaacatcagcagagacacttgaagcagatatgcttaaggtcttgtctgacctcaatcacgctagtcaaaaaggtcttcaaactatctttgactcatctgttggtcgttcaaccgttaaccacccaatcggtggtcgttaccaaatcacaccgacagaaagttctgttcaaaaattgccagttcaatatggtgtgacaacaacagcatctgttatggctcaaggttacaatccttatattgcagagtggtcaccttatcacggtgctgcctatgctgttattgaagcgacagctcgcttggtagcaacgggtgctgactggtctcgtgcacgtttctcttaccaagagtatttcgagcgtatggataaacaggcagagcgttttggtcagccagtatcagctcttcttggttctattgaggctcagattcaatttggtttgccatcaatcggcggtaaggactctatgtctggtactttcgaagaattgacagtaccaccaaccttggtagctttcggtgtgacaacagcggacagccgcaaggttctctctcctgagtttaaagcggctggtgagaatatctactacattccaggtcaagctatttcagaagatattgattttgaccttatcaaggctaactttagccagtttgaggctattcaagctcaacataagattaccgctgcctcagccgttaaatacggtggtgtcctagaaagtcttgctctcatgacttttggtaaccgtatcggtgcttctgttgaaattgcagagcttgacagcagcttgacagctcaactcggaggctttgtctttacatcagttgaggaaattgctgacgttgtgaagatcggtcaaactcaggcagactttacagtcactgtcaatggaaatgacctagctggtgcaagccttctatcagccttcgaaggtaaattagaagaagtttacccaacagagtttgaacaggtagatgctattgaggaagttcctgctgtggtatcagatgttgttatcaaggctaaggaaattattgaaaaaccagtagtttacatcccagtctttcctggtactaactcagagtacgattcagctaaggcctttgaacaggttggagctagcgtcaacttggtgccatttgtaaccttgaatgaggctgctattgctgagtcagttgatacgatggttgctaatattgctaaggcaaatatcatcttctttgctggaggtttctcagcagcggatgaaccagatggctctgctaagtttatcgtcaatatcttgcttaacgagaaggttcgcgcagctattgacagcttcatcgaaaaaggtggccttatcatcggtatctgtaatggtttccaagcccttgttaaatcaggtcttcttccatacggaaacttcgaggaagctggtgagacaagtccaaccctcttctataacgatgctaaccagcacgttgcaaagatggttgagactcgtatcgcaaataccaattcaccttggttggcaggagttgaggtcggcgatattcatgtcattccagtttcacacggtgaaggtaaatttgttgtcagcgcttctgaatttgcagagctaagagacaatggtcaaatctggagccaatatgtggactttgacggacaaccatctatggattctaaatacaatccaaacggctctgtcaatgccatcgaagggattaccagcaagaatggtcaaatcatcggtaagatggggcactcagaacgctgggaagacggactcttccaaaatatccctggaaacaaagaccaaaaactctttgaaagtgctgtaaaatactttacagggaagtgagagtgggacaaaaatcggtaattccaaaggaattcgattttgtcgtccccctccgcacagttgagtggggctgtaagagttgatttatcagcgaattagagcccactcaacccctacgttttgcgaactagattataaaaaatatggaggcttaggacttttgtcctagctttagccctcgccttgaattagtgaaggcgaggttagatagaaattcgctatcttttgaacgaagcgagcttaaccgtatctttccgccgtattggtatttgggagtcattgagactaaggttcaatggctagcttgatagattttctattttaatgttggcattgatgacgacagatccaaaattgagaaaatcatcaaagctacttaagaagagatacaaaaagaattaggaaaaaagaatgacatacgaagtaaaatctctaaatgaagaatgtggagtctttggtatctgggggtatcctcaggcagctcaagtcacttactttgggcttcatagccttcaacatcgcggtcaagaaggagctggtattatttcaaatgataatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgatgggcaatttgctttatgtcataatggtaatttgacaaatgctatttcctcaaggaaagaattagaaaagcaaggtgcaattttcaatgcctcctcagatactgaaattttaatgcatttgattcgtcgaagccataacccaagttttatggggaaggtaaaagaagctttaagcactgtaaagggaggtttcgcctatctactgatgacagaagataaattaattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggtgaagttattcttatagacgatagtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggccttgtaaaaaatcagtatacgcagcgaacctttattcaaccgacacaagaattaagggaacaaggtgttcgaatgaaattatcagcggtatctggtgttgtcaaaggaaagcgcgttgttatgattgatgactcaattgtaagaggaacgacttctagaaggattgtaggattattaagagaagcaggagctactgaagtacatgttgctatagctagtccagaattaaagtatccttgtttttatggaattgatattcaaacaagacgagaattaatttcagcaaatcacgctgttgacgaagtgtgtgatattattggcgcagatagtctaacttatctatcaatcgatgggttaattaaatcaattggactcgaaacaaaagcaccaaatggtggtttatgcgtagcttactttgatggacattatccaacaccgctttatgattatgaagaagaatacctcagaagtttagaagaaaaaacaagtttttatattcaaaaagtgaaataagctctgctaattatataaggagaaaacatgtctgaaaaaaatgcttatgcccagtctggtgttgatgtagaagcgggctacgaagttgtcgaacgtatcaagaaacacgttgctcgcacagaacgtgctggtgtcatgggagctctcggtggctttggtggtatgtttgacctgtcacaaacaggtgttaaagaacctgtcttgatttcagggactgacggtgtcggaactaaactcatgcttgctatcaagtacgacaagcacgacacaatcggtcaagactgtgttgccatgtgtgtcaacgatattattgcagcaggtgctgagcccctttacttccttgactatgtcgcgactggtaaaaacgaacctgccaaattggaacaggttgtcgctggtgttgctgaaggttgtgttcaagctagcgcagctcttatcggtggtgaaacggctgagatgcctggtatgtatggcgaagatgattatgaccttgcaggctttgctgttggtgtggctgaaaaatctcaaatcatcgacggttcaaaggtaaaagaaggggatattcttcttggacttgcttcaagtggtatccattcaaatggttattcattggtacgtcgtgtctttgctgactacactggtgatgaggtgcttccagagcttgaaggcaaacaactcaaggatgtccttcttgagccaactcgtatctatgttaaagcagctctgccattgatcaaggaagaactagttaacggtatcgcccacatcacgggtggtggttttatcgagaatgttcctcgtatgtttgcggatgatttggctgcggaaatcgatgaggataaggtgcctgtacttccgattttcaaggcgcttgaaaaatatggtgacatcaagcacgaagaaatgtttgaaatcttcaacatgggtgtcggtcttatgctggatgttaaccctgaaaatgttgaccgtgtcaaagaacttttggacgaaccagtctatgaaatcggtcgtatcatcaagaaagcagacgatagtgtggtgattaaataagtcactaaattttataagaaaggagtgtttagttagtttgcctaactgaacacgggattaaatttctaggaaaaaagataaaacgacttagacgcaagcgtcgttgttcgttttcctatttttctacgaaatttttcggcaagccgaatcatccctttgtatcgaatatgaaaatcgctgtttttgcttctggtaatggttccaactttcaggtcatagcagagcagtttcaagttagttttgtcttttcagatcatcgtgatgcctatgttttagagcgtgctcagaacttagccattccaagcttcgcttttgaactcaaagagtttgagaataaggcggcttacgagcaagccgtcgttgatttgttggacaaacacgagattgacttggtctgtctggcgggctacatgaagattgtcggagaaaccttgctctcagcctatgaagggcgtatcatcaatattcacccaacctatctgcctgaatttccaggtgctcacggtatcaaggatgcttgggaggcaggtgttgaccagtctggtgtgaccatccattgggtggactctggtgtggataccggtcaggtcatccaacaagtgcacgtgccacgcctagcagatgatagtctagaaagctttgaaacccgcatccacgaaaccgaataccaactctacccagctgtcttagatagcttgggcataaagagaaaatagtaaaatttgttataataagctaatgaaactagtgaaaaatttagagatagtagagtctatttttggtgattgggacgagaccataatctggtcgtgtgtccaaggtattatgggagaagtttttgtagatagtttagaccaaccaaaatcttctttggcaaaattgggaaggaaatcatcttttggttttctagcaggtcagcctactttatttctactagaagtttgctctggggaggatattatccttgttcctcagcataaaggatggtcagatttgattgaatcaacttatggtcagaatgctcattcttttaagcgttatgcgacgaaaaaagatactttgtttgagcgaagtaggttagagaagtttgttactcagttgccaaatggttttgaattacgtgctattgatgagaaagtttacaactcttgcttagaaaaggaatggtcacaggatttagtagcaaattacgctacttatcagtactataaaaaacaaggtataggttatgttgtatattatcaggggaatatcattgcaggagcttcatcttattcaacctataaaaatgggattgagatagaagtagatacgcatccagattttcgtcggcgtggtttagcaacaatagttgcagctcagttaatactaacttgtttagataagggaatttatcctagctgggatgctcatacaaggacttcattgaatttatctgaaaaactcggttatgaattttctcatgaatacatagcctatgaaatagattgaagtaagaaaaggagaactcatgactaaacgtgctttaatctcagtttctgacaaatcaggaattattgactttgcaaaagaattgaaaaacttgggttgggatattatctcaactggtgggactaaggttgcccttgatgatgctggtgttgagaccattgccatcgacgatgtgactggattcccagaaatgatggacggtcgtgttaagaccctccacccaaacattcacggtgggcttctggctcgtcgcgacgctgacagccaccttcaggctgctaaggacaacaatattgagttgattgacctcgtggttgtcaacctctatcccttcaaggagaccatccttcgcccagacgtgacctacgatttggcggtggaaaatatcgacatcggcggtccatcaatgcttcgctcagctgctaaaaaccacgctagcgtaaccgttgtggttgattcagctgactatgccactgttttgggagaattggctgacgctagtcagacgacatttaaaactcgtcaacgcttggcagctaaggccttccgtcatacggcagcctacgacgctttgattgctgagtacttcacagctcaagtgggagaggctaagcctgaaaaattgaccatcacttatgaccttaaacaggctatgcgttacggagaaaatccacagcaagacgctgatttctaccaaaaagccttaccaacagactactcaatcgcttcagctaaacagctcaatggaaaagaattgtccttcaataatatccgtgatgctgatgcagcaatccgtattatccgcgatttcaaagacagtccaacggttgttgccctcaaacacatgaacccatgtggtatcggacaggctgatgatattgagacagcttgggattacgcttatgaagctgatccagtttcaatctttggtggaattgttgtccttaaccgtgaagttgacgcagcgacagctgagaagatgcaccctatcttcttggaaatcatcatcgcaccatcatactcagaagaagcgctagctattctcacaaataaaaagaaaaacttgcgtatccttgagttgccgtttgatgcccaagctgccagcgaagtggaagctgagtacactggcgtagttggtggacttttggtgcaaaaccaagacgttgtggctgaaaatccatctgactggcaagtggtgacagaccgccagccaacagaacaagaggcgactgcccttgagtttgcctggaaggctatcaagtatgttaagtctaacgggattattattactaacgatcacatgacgcttggactcggtgcaggtcaaaccaaccgtgtcggctcagtcaagattgctatcgagcaggctaaggaccaccttgacggtgccgttctagcatcagatgccttcttcccatttgcggacaacattgaagaaatcgctgccgcagggatcaaagcaatcatccaaccaggtggttcagttcgtgaccaagaatctattgacgccgcaaacaaacatggcttgaccatgatcttcacaggcgtgagacattttagacattaaaaaatagtagtttaggttttcttaagttaactcaggtatactacgtatatcctaaaaacttttctttttattaaacctcctaagtactcatcaaggtgagtactttttttgatattttgatttaaattttcgaataagttaattgcaagtgtttgagcacttcattatattaattctatttggaggtttttcttgaataaatggttagttaaggcaagttccttagttgttttaggtggtatggttttatctgcgggttcccgagttttagcggatacttatgtccgtccaattgataatggtagaattacaacaggtttcaatggttatcctggacattgtggggtggattatgctgttccgactggaacgattattagggcagtggcagatggtactgtgaaatttgcaggagctggagccaacttttcttggatgacagacttagcaggaaattgtgtcatgattcaacatgcggatggaatgcatagtggttacgctcatatgtcacgtgtggtggctaggactggggaaaaagtcaaacaaggagatatcatcggttacgtaggagcaactggtatggcgacgggacctcaccttcattttgaatttttaccagctaaccctaattttcaaaatggtttccatggacgtatcaatccaacgtcactaattgctaatgttgcgacctttagtggaaaaacgcaagcatcagctccaagcattaagccattacaatcagctcctgtacagaatcaatctagtaaattaaaagtgtatcgagtagatgaattacaaaaggttaatggtgtttggttagtcaaaaataacaccctaacgccgactgggtttgattggaacgataatggtataccagcatcagaaattgatgaggttgatgctaatggtaatttgacagctgaccaggttcttcaaaaaggtggttactttatctttaatcctaaaactcttaagactgtagaaaaacccatccaaggaacagctggtttaacttgggctaagacacgctttgctaatggtagttcagtttggcttcgcgttgacaacagtcaagaactgctttacaaatagtttgaggtattgattcattgttttaaatgacagttgtgttactaactaagtacaatttctttaaaccgtctgaaaataattttatagtccagtaaagtgtgatattatagtctcggactaataaaaaggaaataggaattgaagcaatgaaaatgaataaaaaggtactattgacatcgacaatggcagcttcgctattatcagtcgcaagtgttcaagcacaagaaacagatacgacgtggacagcacgtactgtttcagaggtaaaggctgatttggtaaagcaagacaataaatcatcatatactgtgaaatatggtgatacactaagcgttatttcagaagcaatgtcaattgatatgaatgtcttagcaaaaataaataacattgcagatatcaatcttatttatcctgagacaacactgacagtaacttacgatcagaagagtcatactgccacttcaatgaaaatagaaacaccagcaacaaatgctgctggtcaaacaacagctactgtggatttgaaaaccaatcaagtttctgttgcagaccaaaaagtttctctcaatacaatttcggaaggtatgacaccagaagcagcaacaacgattgtttcgccaatgaagacatattcttctgcgccagctttgaaatcaaaagaagtattagcacaagagcaagctgttagtcaagcagcagctaatgaacaggtatcaccagctcctgtgaagtcgattacttcagaagttccagcagctaaagaggaagttaaaccaactcagacgtcagtcagtcagtcaacaacagtatcaccagcttctgttgccgctgaaacaccagctccagtagctaaagtagcaccggtaagaactgtagcagcccctagagtggcaagtgttaaagtagtcactcctaaagtagaaactggtgcatcaccagagcatgtatcagctccagcagttcctgtgactacgacttcaccagctacagacagtaagttacaagcgactgaagttaagagcgttccggtagcacaaaaagctccaacagcaacaccggtagcacaaccagcttcaacaacaaatgcagtagctgcacatcctgaaaatgcagggctccaacctcatgttgcagcttataaagaaaaagtagcgtcaacttatggagttaatgaattcagtacataccgtgcgggagatccaggtgatcatggtaaaggtttagcagttgactttattgtaggtactaatcaagcacttggtaataaagttgcacagtactctacacaaaatatggcagcaaataacatttcatatgttatctggcaacaaaagttttactcaaatacaaacagtatttatggacctgctaatacttggaatgcaatgccagatcgtggtggcgttactgccaaccactatgaccacgttcacgtatcatttaacaaataatataaaaaaggaagctatttggcttcttttttatatgccttgaatagactttcaaggttcttatataatttttattaaattgaggagattaagctataagtctgaaactactttcacgttaaccgtgactaaatcaaaacgttaaaactaaaatctaagtccgtaaagattattgaaaacgctttaaaaatagatataataaggtttgtagatatctaaaattaaaaaagataaggaagtgagaatatgccacatctaagtaaagaagcttttaaaaagcaaataaaaaatggcattattgtgtcatgtcaagctttgcccggggagcctctttatactgaaagtggaggtgttatgcctcttttagctttggcagctcaagaagcaggagcggttggtataagagccaatagtgtccgcgacattaaggaaattcaagaggttactaatttacctatcatcggcattattaaacgtgaatatcctccacaagaaccatttatcactgctacgatgacagaggtggatcaattagctagtttagatattgcagtaatagccttagattgtacacttagagagcgtcatgatggtttgagtgtagttgagtttattcaaaagataaaaaggaaatatcctgaacagttgttaatggctgatataagtacttttgaagaaggcaaaaatgcttttgaagcaggagttgattttgtgggtacaactctatctggatacacagattacagccgccaagaagaaggaccggatatagaactccttaataagctctgtcaagccggtatagatgtgattgcggaaggtaaaattcatactcctaagcaggctaatgaaattaatcatataggtgttgcaggaattgtagttggtggtgctatcactagaccaaaagaaatagcggagcgtttcatctcaggacttagttaaaagtgttactcaaaaatcaaaatcaaaataaaaaaggggaatagttatgagtatcaaaaaaagtgtgattggtttttgcctcggagctgcagcattatcaatgtttgcttgtgtagacagtagtcaatctgttatggctgccgagaaggataaagtcgaaattacgtggtgggcttttccaacctttactcaagaaaaggctaaggatggagtaggtacttatgagaaaaaagtcatcaaggcttttgaaaagaaaaatcctaatataaaagtaaaactagagacaattgatttcacatctggacctgaaaaaatcactacagcgattgaagcagggacagcacctgatgtgctttttgatgcaccagggcgaattattcaatatggtaaaaatggtaaattagcagatttgaatgatttatttacagaccaatttattaaggatgtcaataataagaatatcattcaagcttctaagtctggcgataaagcctacatgtatccaataagttctgccccattttatatggcgttcaataaaaaaatgcttaaagatgcaggagttttgaaactcgtaaaagaaggttggactactagtgattttgaaaaagtactaaaagcactaaaaaataaaggctatacaccaggttcattctttgcaaacgggcaaggaggagatcaaggaccacgtgcattttttgctaatctttatagtgctccaataacagataaagaagtaacaaaatataccactgacactaaaaattctgtaaaatcaatgaaaaaaatagttgaatggattaagaaaggctacttgatgaatgggtctcagtatgatggctcagctgacattcaaaactttgccaatggacaaactgctttcactatcctatgggctccagctcaacccaaaactcaagcaaaattattagagtcaagtaaagtggattaccttgaagtgccattcccatcagaagatggaaaaccagatttagaataccttgttaatggttttgcggtctttaataataaagatgaaaacaaagtaaaagcctctaagaaatttatcacttttattgctgacgataaaaaatggggaccaaaagatgttatacgtacaggtgctttcccagttagaacatcatttggagatctttataaaggtgataaacgtatgatgaagatttcaaaatggactcaatattattcaccatattacaacactatcgatggattttctgaaatgagaaccttatggttcccaatggttcaatctgtatccaatggtgacgaaaaaccagcagatgctttgaaagactttactcaaaaagcaaatgataccattaaaaaagcagctaaataattaaggagactccttttctatggtcaatcacatattgggatagaagaggagtttttagtcaagttaagatgtaaaggagagtaccgtatgcgtactaataagttaaagatgagggaaacgatgatagcttatgcttttctagcacctattctcttatttttcttaatttttgtttttgcaccgatggttatgggctttgtcactagtttttttaattattctatgacacagttcacttttattgggttagctaattacaatcgtatgtttcatgattctattttcatgaaatccttgataaatacagtaatcattgtgattggctctgtgccagtagtggttttcttctcactttttgttgctgccaatacttatgaaaaaaatgttttttcacgctctttctaccgttgtgtcttcttcttgccagtagtaactggtagtgttgcagttacagttgtttggaaatggatttatgaccctatgtccggaattttaaattacatcttgaaatcaggtcatgtcattgaacagaatattagctggcttggggataagcactgggcattgcttgctattattattattttgctaacgacctcagttggtcaacctattattctatatattgcggcgatgggaaatattgataattctctttgcgaagctgcgcgtgttgatggagccaatgaaatgcaagttttttggcaaattaaatggccgagtctcttaccaactacactctatattgcagttataacaacaattaattcatttcaatgttttgccttaatccagctcctaacatctggtggaccaaattattcaacaagcactttgatgtattatctttatgaaaaagcctttaaactatcagaatatggctatgctaatactatgggagtattcctagcagtaatgattgctttaataagttttgctcaatttaagatcttaggaaatgatgtggaatattaggaggaaaacatgaaaaagaaaacattcagtgcttataactttttaacggctcttatcctttgtcttttgacagtgctttttatctttccattttattggattatgacaggagcttttaaatctcaacctgatactattatcatccccccacaatggtggcccaaagcaccgaccttagaaaattttaaagctttaactgtacaaaacccagctttgagatggctttggaatagtgtctttatctcaattatgacaatgttcctagtttgctgtacatcgtcaatggcaggctatgttttagctaagaaacgattttacggtcaaaaaatattgttctccctttttattgctgctatggctttacctaaacaagttgttttagtgccattagttagaattatcaattttatggggatacatgataccttatgggcggttattttacctcttgttggttggccttttggggtcttcttgatgaaacagttttctgaaaatattccaacagaattactggaatcagctaaaattgatggttgtggagagattcgaacatttattaatgtagcatttccaattgtcaaacctggatttgctgccctagctattttcacatttatcaatacttggaatgactattttatgcaattagttatgctaacttctagaaataatctgaccatttctcttggggtagctactatgcaggctgaaatggcaacaaactatggcttaattatggcaggtgcagccttagctgctgttcctattgtgacagtattcttagttttccaaaaatcctttactcaggggattacaatgggagctgttaaaggataggtaggatttattatgatttacgatcatttattgaatttaacgcattataaagatattaatcctaatttagatttagcgattgattatctactaagtcatgatttaaggaatttagatataggcacctatcatattagcccagaagtgatactcatggtccaatcaaatcaacttagtgagtcatttgatcatatttttgaataccataaaaaataccttgatatacattatgtcattgaaggacatgaagttatcaaattgggaaaaggtgataaggtagaggtggaggaatacttaggcgatataggatttatcaagtgctcagaagagacttcttttgatttgagagataattatatagccttctttttcccagaagaagctcatcagccaaatggtatgggaagtctaggtaattatgtcaaaaaaggggtattgaaagtgttaatggcgtaagaaatacagggagtatattgtgaaaaaagcaaatcaattaatagcagcgatttttgatgttaacaacccctttatgcaaggttgcaatgttgtttttgatctggcattactaaaccttctctttatgataacttgcctaccattggtaactattggtgctgctaaaattagtttgtatcgaacgttgtggcaaaaattagaaggtgatcagacaaatcttttaatattgtatataaaacacctaaaaaaagagtggttccaaggtatgcttttaggtttggttgaactaagtattttggttgtgatcatatttgatttaacaattcttcattatcaaataggtttcattgtgtctttcttgaagataacttgttacgcctttttgttattgactgtgatgacgagcatatacctatttcctatggctgcccgctacgaaatgtctcttttagataccgtgaaaaagagctttataatggcatgtttaaacttgaaatggactggtgtattgatgtttttattaatcatgacttggtttattatggtgcagtctagtctcttatttatgcttacagtgtcagctatatttatttttgcttataccgcctttgcttactttaaaattattattttacaaaaacaatttgcctatttcagcaaacaacaaggagattatcaatgaaagatttacaaaaatatcaaggaattattcctgcattttatgcttgctatgatgataagggtgatatttgtcccgaacgagtaaaagccctgaccaattattttattgataaaggtgttcaaggactttatgttaatggttcatccggagaatgtatttaccaaagtgtagcagatcgtaaacttgtactggaaaatgttatgtccgttgctaagggtaaactaacagtaatagcgcatgtggcatgtaataatactaaggatagcgtagagttggctatgcatgctgaagctataggtgttgatgctattgcagcaattccaccaatttattttcgattaccagagtatgccatagcagattattggaatactattagtcaagcagcaccacaaactgattttattatttacaatattcctcaattggcaggggttgctttgacatcggatttatatcgaaaaatgttacaaaatccgcaagtaattggtgttaaaaattcttccatgccagttcaagacattcagaattttgtggctattggaggagaaaatcatattgtttttaatggtccagatgaacaatttttgggtggtcgtctcatgggagccgctgcaggtattggtggtacctatggcgtaatgccagaattatacttgactttaaatcagttaattgttgataaagatttagaaaaagcgcgtgaacttcaatttacaattaacgatattatcacaaagctttgttcgggtcatggtaatatgtatgctgtgatcaaagctgtattggaaatcaatgagcaactaactataggttccgttcggttacctttagcatctgtaacagaagaagataaacctattattaaagaggcagcagaaatgattagacatgctaaaaaacagttttgttaaagtgaggtagataattatgaccagaacagtagcaattgatattggcggtacaatgattaagcatggcattgtggataatttaggttgtattgttgaggcaagtgagcttgccacagaagcctacaaaggtggtccaggcattttacaaaaagtttgtcaaattatcgataactatctagcagaagggagcattgatggaattgctatctcatctgctggcatggtagatccagatgaaggatgtatattttactctggtcctcaaattccaaactatgctgggacacaatttaagaaagttttagaagacacttatcaagtacgcacagaaattgaaaatgatgttaattgtgcaggattagctgaagctgtctcaggtagtgccaaagatagttcaatagcgctttgtcttactattggaacaggtattggtggttgtctgattattgataaaacagtttttcatggctttagtaattctgcttgtgaagttggctatatgcacctttcagatggtgattttcaagatttagcctctacaactgcactgattgctgatgttgccaaagcgcatggagatgaaattagccgatgggatggacgtcgtatttttcaggaggctaaaaaaggcaatgaaaaatgtattgcaagtatagaccgtatgataaactaccttggccaaggaatcgctaatatggtttatgtggtaaatcctgaaaaagttgttttaggtggtggaatcatggctcaaaaagattatttacaagataaacttagtgaatctttgaaacgaaatcttgtgacaagtcttgctgaaaaaacagcaatagtctttgcacaacacgaaaaccaagctggtatgctaggagcttactaccattttaaaaacagggggtgacgggtatatgattgaaacaatgtcgctagatgacatgagagaatacctaggtcaagaccaaattcccgaggattttgatgacttctggaaaaaacaaacaatgaaatatcaagggaatattgagtatcgtctagacaaaaaagatttcaatattacttttgcacaagcttatgatcttcattttaaaggcagcaataactctattgtctatgccaaatgtttattccctaaaacaaataaaccctatcctgtagttttttattttcatggttaccaaaaccaaagtcctgactggagtgaccaacttaattatgtagcagcaggttacggcgttgtttcaatggatgttcgaggtcaagctggacagtctcaagacaaggggcattttgatggcattacagttaagggccagattgtgcgaggaatgatctcaggaccaaatcatcttttttataaagacatttatcttgatgttttccaattgattgatatcattgctacattagagagtgttgatagtaatcaactttatagttatggctggtctcaaggtggagcacttgctttgatagctgcagctcttaatcccaaaatcgtcaagaccgttgctgtttacccatttttgtcagactttagacgagtattagatttagggggtgtcagtgagccctatgatgaactcttccgctattttaaatatagtgatccttttcataaaacagagaataatgtgttaaaaactttggcttatattgatgttaaaaattttgcacataggatttcttgccccgttgttttactaacagccttaaaagatgatatttgtcctccatcaactcaatttgccatttttaatcgtctgacatcaactaaaaagcatcttttattaccagattatggacatgatccaatgacagtgcaagtaaaagaccatatttttgatcaactgacaggaagtcaatttacaaagcaaaaaatcgagtagattatttctactcgattttcatttagcgttgaataatggtttctctaaaaattcgctctttttctattttattaatatctaaaaattgtgcatagataatatctaccatgattaacattgggatctgaggcgaaattctattgccgtagtctaaatgcctagcagaagccacctgaataatcttgtcaaaagcatagtcaattgtgtgaggttgttttgtaaatagaacggttttagctccgtgacaacttgcgatttttaaggcaccaataacagagttggtgttcccagaaagtgagaaggcaatgacgaggcatctatcattaacaatactattagtccatgagaaactatctgtatcatccagagcctcacaaatcactcccagcctcataaggcgtattttaaattctttagctactagcgatgagctccctttgccataaaaataaacacgatcagcttgctcaatcatatgtgatacttctagaagctgttcttcatcaataatatcagcagatttagaaatcatctcttgataattcataaatactttcttagtgttgtcattttgaagaccgtataattgttgactgatggtctcatggctttttaaatattcaaaaacaaattcacgatagcctttaaacccacattttttagcaaaacgcgttaaggctgcttgtgaaatgtgtagttgcttagtgacaatggtagaagcaagagcgtcttttgaaatgggctgccccataaaataacaagcaatttcacgttctaaatcagtcattaaatcaagagcagactcaatttggtcataaatagtcataatacacggtcctctcctctttaagaaagcgcttaatatattcagtataacataaagttagtgagggaccaaactaagttctaagaaacagcaatgataagttttaaatagcaatatgaaggatcaataacataatatatgttaagtatatattatgatataaatttttcaaaaaagctgtaataaaaaaaataaaagcgaacaaatgtgttataattttataaatgatacgtttttattgaaaatttctttttatattatttaataggagttattctgatatgaaattgcttgttgttggttctggtggtcgtgagcatgcgattgctaagaagttgttagcgtctaaggatgtggatcaggtttttgtggcacctggtaatgatggtatgaccttggatggtctagacttggtaaatatcggaatttccgaacattctagactgattgactttgttaaggagaatgagattgcttggacccttattggtcctgatgatgcgctagcagctggtatcgttgatggttttaatagtgctggactcagagcatttggtccaaccaaggcagccgcggagctagagtggtcaaaagactttgccaaggaaatcatggtcaaatacaatgttccaacagcagcctatggcacattttcagattttgaaaaagctaaagcctacatcgaagagcagggcgcaccaatcgtggtcaaggctgacggattggcgttaggcaagggcgtggtcgtggctgaaaccgttgagcaggcggtagaggcggcgcaagagatgcttttggacaacaagtttggcgactcgggtgcgcgcgtggttatcgaggaattcttggatggtgaagagttctcccttttcgccttcgctaatggcgataagttctacatcatgccgacagctcaggatcacaagcgtgcctatgatggtgacaaggggctaaataccggtggtatgggtgcctatgcgccagttccccacctgcctcagagcgtggtggatacagcagttgagactatcgttaagcctgtccttgaaggcatgattgccgaagggcgtccttatctaggtgtcctctatgctgggcttatcctgacggctgatggccctaaggttatcgagttcaactcacgttttggtgaccctgaaactcagattatcctccctcgcctgacttccgatttcgctcagaacatcgacgacatcatgatgggcatcgagccttacatcacttggcagaaggacggcgtgactctgggcgttgtcgttgcctcagaaggctatccgctcgattacgagaaaggtgtgccactgcctgaaaagaccgacggcgacatcatcacctactatgcgggagctaagtttgcggaaaatagcaaagcactgctctcaaacggaggacgtgtctacatgcttgtcaccacagaagacagcgtcaaagcagggcaggacaaaatctatacccaactcgcccaacaagacacaacaggcctcttctaccgaaacgacatcggaagcaaagctattaaggaataagactactcattcaaatattagcgtcagcaaagcgaccgaaggtcgctccaaaaagaaagaagaaaggaactgaacacgggactaattttctagtgaaaaagataaatcttcctagatgctaaagcatcttcgtcagatttctgcgtcgtaggcgtctgctgctaaagcacctagtcgccctgacgtgggtacgtcttcgaaatcaaagatttcggacttaccgcatatttttctacgaaaattttcgacaagtcgaaacgtccctttgtatcttaatattatgcaaccaattatttctattatcatgggttccaaatccgactggacaaccatgcaaaaaacggctgaagttctagataactttggcattgcttacgagaagaaagtcgtctctgcccaccgtacgccagacctcatgttcaagcatgctgaggaggcgcgtggtcgtggtatcaagattatcatcgctggagcaggtggagcagcccacttgccgggtatggtagcagctaaaacaaccctgcctgttatcggtgtgcctgtcaaatcacgtgccctctcaggtttggattcgctctactctattgtgcagatgcctggtggtgtgcctgtggcgaccatggctatcggagaagcaggagcgactaacgctgccctgacagccctccgtatcctctctatcgaggatcaaaatctggctgatgcgctagctcatttccatgaggaacaaggaaaaatcgcagaggagtcaagcaatgaactcatttaagaccattgggattattggtggtggtcagctggggcagatgatggcgattgcggctatctacatgggccacaaggtcattacgctggatccagctagcgactgccctgcctcccgcgttagcgaggtgattgtggcaccttacgatgatgttgaggctttgggaacattagctgcgcgttgcgatgttttgacctatgagtttgagaatgtcgatgccgatggtctggatgccgttgtgtcagctggtcagctaccgcaggggactgatctgctccgcatttctcaaaaccgtatctttgaaaaagactttctggcaaataaggctggcgtgactgtcgctccctataaggtggtgacatctagccttgacctagaggggcttgacttgaccaagacctatgtcctcaagacagcgacaggtggttatgacggtcatgggcaaaaggttatccgctcagcagaagacctgccagaggcgcagcaattagccaactcagctcagtgtgtcttggaagagtttgtcaacttcgaccttgaaatatcagtcatcgtgtctggaaatggtcaggatgtgacggtctttcccgttcaggaaaatatccaccgcaacaatatcctgtcaaaaaccatcgtaccagctcgcatctcagaccaactagctgacaaggctaaggaaatggctgtgcagattgccaagaaactccagctatcaggaaccctctgtgtggaaatgtttgcgaccgcagatgacatcatcgtcaatgaaattgccccacgtccccacaactcagggcactactctatcgaagcctgcgacttttcacagtttgacacccacatcttgggcgtactgggcgcaccgcttccgccaatcaaactccatgctccagccgttatgttcaatgtcctaggacaacatgtccagcaggcaattgaccatgttgcccaaaaccctagcgcccacctccacatgtatggtaaactagaagcaaaacataaccgcaaaatgggacacgtgacggtgtttagcgatgtacctgatgaggtggaagagtttgaagaaaggatggatttctaaggaggtttatggaattttaggggggagaatgattttgaagggagtgttgtcagatgaatagaataataaacagggatattttacctagaatttcaaagatttctaaaaataataaagagaaagatttactatctatagcttatattacttggctaatctttataatatttgctttgggagtagttacagttaatgatttaaaaccgatgtttaatcaattaatagtaaacctcttaaatatttattattatatggaagccttcatattgggtatggacagctatttacaatataaccttccatacagttttgatttttggagtatttttgtagaggctataaatttatttgtaaaagtatttttaattgcttttattccttctgttattagaaaagtattgaaaaaagaaagttttttcaatgaagttgttattttactaggagcgattgttactataattgtaagtttccatttatatttagagatattgatagtagtgggactaatacttttattaattgcttttgtttcaataggtaagaatcgtgtttataattttgttcaaaatttaaactactttgaagaagtgatttggaattattttgaagaaaatccggttaaaataaaagaaaaatcattgattattaaatttttacttactatttcttttgtttttgtaattgattttgcaatggttagattgttgaattttaatataaaattttctacaatattagcttgttctgctattttattagcatggttataccaaaataagtctgttacagaacccttcctattaaaaaagttagttatctattttatttttttcattgccactttaattggtaatttaaaaaatgagttgtcaatcttagaaacaccattactttttattagtatattttttactatggatagaattattgctctatctaaagaaatgcgtgatttgattatatctaagagtattttattttattatgatcatgaaaatataaagccatcaatattacttagtgagataaaagaaattaagtatcttgaaaatgtagatattggagaacttgaacttgttaggcaaatggtaattaggttgcgtctagagttagaggaagaatttttgattttatcagatatatatatgaaaaatggctatgaaaaatatatacaatttgttcaaggaaatgtttattttatcaacttagaattggataaaattcccaactacactaacttgaaattaatactagaatcaatatttgatcataataatcaaaagatatttatacctaaactttatgaggaatacatatacatcttaatttctttaggagaagttgaaaaagctaaagaaatattaaaagaagtgtcggattatttaactgaagaatctttgaattattttgaaaaagaatatgataaagctaagggtagtaattagaattttttaaaggagtaaaacaaaatgatcgaacgttattcacgccctgagatggcggcaatttggacagaggaaaataaataccgtgcttggttggaggtcgagattttggctgacgaggcatgggctgagttgggtgagattcctaaggaggatgtggctaagattcgtgagaaggcggattttgacattgaccgcattcttgagattgagcaggacacgcgtcacgatgtggtggctttcactcgtgcggtttctgagacgcttggtgaggagcgcaagtgggtgcactacggtttgacgtcgactgacgtggtggacactgcctacggttacctctacaagcaggctaacgatattatccgtcgtgaccttgagaatttcacaaatattgtggctgataaggctaaggagcacaagttcaccatcatgatgggtcgtacccacggtgttcacgctgagccaacgactttcggtcttaagttggcgacctggtacagcgagatgaaacgtaatattgagcgttttgaacatgctgccgcaggtgtggaagctggtaagatttcaggtgccgttggtaactttgctaacattcctccatttgtggaacaatatgtttgtgacaaattgggcatccgtccgcaagagatttcaacacaggttcttccacgtgacctccacgcagaatattttgcagtgcttgcaagcattgcaacttctatcgaacgtatggcgacagagattcgtggtctgcaaaaatcagaacaacgtgaagttgaagaattctttgccaaaggtcagaaaggtagctctgctatgcctcacaaacgcaacccaatcggttcagagaacatgactgggctagcgcgcgtgattcgtggtcacatggtgacggcttatgagaacgtggcactttggcacgagcgtgatatttcgcactcatctgctgagcgtatcatcacacctgacacaacgatcttgattgactacatgctcaaccgttttggcaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaggaagaaattgatgaactatttaatccgatttattacacaaaacgtgttgatgatatttttgaaagactaggattagaaaaataagaaaattccattactggttaacgtttttttaaccagtaatggaatttttattgatttaaaaggaattaatattaaaaaacatacttaaaatgagtttattatgataatatataataagaagaaaaatttaggagttagtttttaaaggaaaatgttaaaacattttggtagtaaagtaagaaatttgagagtaactagaaatattactcgcgaagatttttgtggtgatgaaactgagttatctgtaagacaattagctaggattgaaagtggacagtcaattccaaacttgactaaagctcactacatagctaaacaattgaatgtaaaattggatattttaacaggaggagagagcttagaattacctaaacggtataaagagttgaagtatttgattttaagaattccaacttatgcagatgctgaacgattaaaattaagagaatgtcagtttgatcatattttcgaagaattctatgataatcttccagaagacgagtgcttagcaattgacagtttacaagctaaatttgaagtctatcaaacaggagacattaattttggtgtggaggttttatgcgaatgctttgataaagtaaaatataaagaaaaatatactcttaatgatttgattatcatagatttgtttttaacttgtgcagttgtatctaaatttaacaatagagcatttactaaagaagtatttcaaactatatgtaaaactttgataagtcagaaccacaaacttacagcagaagatttgttttggtttaatcatgtactcctgaattgtgtatttgttggactttgtttaaatagtgaagagtgtcttgcagaaatgttagaagttagccgacaaacgatggtgtcaacacatgattttcataaaatgcctttatattttatgtaccaatggaaatacttcattacaattgacaatgatataaagtctgcagaaaatgcttaccaacaatcaattatgttttcaaaaatgattgatgacaagcatctaattaaaaaattagaattggagtggcaagaagatataacaggacattgatgtcctgtgactctgaggtctaaaaatttataataaacgtacaaaatattatttaggagtttattatagtgattaaaaaatgttttttaatagtattacttgttctattatcaaatttaggttcatttgatttgtttttaggaatgggttggtggaatatgggctaagtaagctgttctgtgatttcttgaggttggattaactataagatcagtttattcttcctttaaataagggagatactaatacaccaacttagttcttaacttttcctatacaaatgttataataatatcatgacaagatttttagatagtgatgcaatgggtgacgaagaattggtagaacgtacacttcgtccgcagtatttaagagagtatattggacaagataaggttaaagatcagctaaaaatatttattgaagctgctaaattgcgtgatgagtcattggatcatgtgttattatttggccctcctggtttagggaaaacaaccatggcatttgtaattgctaatgagttgggtgtcaatctcaaacaaacatcaggtcccgcaattgaaaaatcaggggatttagtagccattttaaatgatttagaaccaggtgatgttctttttattgatgaaattcatcgtatgccgatggcggttgaagaggtactttatagtgcaatggaagacttctatattgacattatgatcggtgcaggagaaactagtagaagtgttcatctagatttgccgccctttaccttaattggtgcaacgacacgtgcaggtatgttatctaatcccttacgtgctcgctttggtattacagggcatatggagtattatgaagaaaatgatttgacagaaattattgagcgtacagcagacatttttgaaatgaaaattacttatgaagctgcttctgaattagcgcgtcgcagtcgtggaacgccacgtatcgctaaccgtttattgaaacgtgttcgagattatgctcaaatcatgggagatggtttgatagatgacaatattacagataaagcattaacgatgttagatgttgatcacgaggggcttgattacgtcgatcaaaaaatcttaagaaccatgattgaaatgtataatggaggtcctgttggtttaggaactctatccgttaatattgctgaagaacgagatactgttgaagacatgtacgaaccttatttaattcaaaaaggttttattatgcgtacccgtaccggtcgtgtagctacggttaaggcatatgaacatttaggttatcagcgatttgataaataaaacataagtcattttaaggctagagtatctagtcttaattttttaattttcatgcaatgttaagtattagatatgttgtagttattctttgagcagttaaacgtattataagtaccttttttctgttataatagaccaaaaggagtttgctatgaagaaagtctgttttgtttgtcttggaaatatctgccgtagcccgatggctgagtttgttatggcgaatttagataaggaggatagcctcttggttgagagtcgtgcgacttcaacatgggagcatggaaatcctatacataggggaacgcaagcgattttgcagcgttatcaaattccttacattaacgataaagggtcacaacctatttctaaagacgatttagcatattttgattatatcatcggtatggatgagcaaaatgtcaaggatttaaaagctctatcacaaggaacctatgatgataagattagtcttttttgtgatggtggtgttcctgatccatggtatactggtgattttgaggaaacctatcgtctagtcaatgatggctgtaaacagtggttaacgctaataaataatagtagagattaagtagaaatgaagaattttaaaataacacgaactcatctagaaatattatctttgataattattgttgtttttggtttatcagtatttaccttaacgacttctagtcaaggagtctttagctatgatggcggcaagataaaatatgtgggctctattgttaatcaccatatgactggtaaaggtaaattaacctatgagaatggggattactataagggcgattttgtaaatggagtctttgaagggaaaggaacatttgtttcagttcatggctggtcttatacaggtgactttaaaaaaggtcaacctgatggacaaggtcgcctcaatgctaaaaataagaaagtctataaggggacatttaaacaggggatttatcaaaaatgagaataaaatggttttctttggtacgtataacaggactactacttgttttactttaccatttctttaagaatagttttccaggaggatttgttggcgttgacatcttctttacattttctggttttctgattacggccttattgattgatgaattttctaaaacgaaaaaaattgattttgttagtttttgtcgtagacgtttttaccgtattttcccaccattagtattgatggttttggtgacaataccttttgtatttctggttaaaagcgattttagagcaagtattggctctcaaattatgactgctttaggttttaccagcaacttttacgaaatcttgactggtggtaactacgaaagtcaatttatccctcacttatttgtgcatacctggagtctttctattgaagtccatttttatgttttatggggcttaacggtatggctcttatcgaaaagatcaaaagatcaaaagcaattgagggggactttgttccttatttccatgggaatttttggagtcagcttccttaccatgtttgttagagcctttttcgttgataatttttcaacgatatatttctctacattatcacatatatttccgttctttttaggagcgatggtggctacaatatctggtattcgagagattaccggacgattcaagaaaaatatcaaaaatctgactttgaagcataatttaatcatgatgggtagtgcttttgctggtctaatgattttaacttttgcacttgattttgataatcggctaacatatctttttggttttgtattgtctagcatttttgctagtgtaatgatttacaatgcacgtattttacacgagcatacaccagatatttcagaaccttttgtgattacttatcttgctgatatcagttacggtatgtacctttttcattggccattttatattatttttagtcgtttatccccaaactggatagctgttattttgacagtagtattatcagcagtcttctcaacattatcattttatatcattgaaccttttattttaggtagaaaacctaaattccttgattatgaatttgacttgttgccttacaaaaagtggttatttagtatcggaggggtactaactcttattactgtagtgacaatgttgacagctccaagtataggtagttttgagacagaattattgcagaattcgttacaacaagctagaacaaatactaaccgaacacatacactagccgcaggggatgcaggtgctcttagtgatgtgacagtaatcggagattcagttgccttaaggtcaagtgctgcttttaataaattgttaccagaagtacaattagatgctgcggtgagtcgtaattttagtaaatcatttgatatttttgaaaaccgtattcaaaataaagccttgtccaaaattgttgttttggcagttggtgtgaattcattagataactacaagacagacttgagccaatttattaaatctttgcctaagggacaccgtttgattatagtaacaccttataatgctaaaaatatgagtcaagttacgacagtgcgtgattatgaactctcgctaatgaaaaaatataattacataacggttgctgactggtataaggttgcgacagaacatccagaaatctggggaaatacagatggtgtgcattatagtgatagcgatactacaggggctgatttatatgttagtaacgtcaaaaaagctattcaaaaatcagctcaacgagctgcaaaataaacaagtccgagtcatgtactcggctttttttgtgaaaacgaataatagatatctccgtttatggtgataaaaatgaaatcgataggctttaatctgaaaattagtaatgaaaaaacaaatataattaaagcgctttcaagaaatatttccgaaagattgaaaaaaagttcacaaaaaagttgtgaaactatttacaaagtttttaaatatgctataataatctcgtaaacaaatttgtgaaacatttaacaaatcaaaaggagtctcaaatgactgaaaaaactaaagcagtagaaactacagatgttgctcttgcaattgatacattggttcaaaatggtttaaaagcacttgatgagatgcgtcaacttaatcaagaacaagttgattatattgtagctaaagcttctgttgcagccttggatgcccatggagaacttgctcttcatgcagtagaagaaactggtcgtggtgtctttgaagataaagcgacaaaaaatttatttgcatgtgaacacgtcgttaacaacatgcgtcatacaaagacagtgggagttattgaagaagacgatgtcacaggcttgacattaattgctgaaccagtgggagttgtctgtggtatcacgccaacaaccaacccaacttcaactgctattttcaagtcattaatctctcttaaaacacgtaatccaattatttttgccttccacccatcagcacaagaatcatcagcacatgcagcacgtattgttcgtgatgctgctattgctgctggagctcctgaaaattgtgtccaatggattgaacaaccatcaattgatgcaactaatgctttgatgaaccatgatggtattgccactatccttgcgacaggtggtaatgcgatggttaaagctgcctactcatgtgggaaacctgcccttggtgtaggtgctgggaatgttccagcttatgttgaaaaatcagctaatatccgacaagccgctcacgatattgttatgtctaaatcatttgataacggtatggtatgtgcatcagaacaggctgttattattgataaagaaatttataaagaatttgttgaagaatttaaatcttatcatacctatttcgttaataagaaagaaaaagctcttcttgaagaattctgttttggtgcaaaagcaaatagcaaaaactgtgctggtgcaaaattaaatccaaatattgttggaaaatcagcagtttggattgctgaacaagctggatttactgttccagaaggaacaaatattcttgccgcagaatgtactgaagttagtgaaaaagaacctttgacacgtgaaaaactatcacctgttattgcagtattgaaagctgaatctacagaagatggtgttgaaaaagctcgtcaaatggttgagtttaatggtctagggcactcagctgctattcatacaaaagatgcagacttagctcgtgaatttggaactagaattcgtgctatccgtgttatttggaattctccttctacttttggtggtattggggatgtttacaatgctttcttgccatcattgactcttggttgtggttcgtatggacgtaactcagttggtgataacgttagtgctataaatctcttgaatatcaaaaaagtaggaagacgtagaaataatatgcaatggtttaaagtcccttcaaaaacatacttcgaacgtgattctattcaatatttgcaaaaatgtcgcgatgttgaacgtgtcatgattgttacagatcacgccatggttgagcttggtttcttggatcgtatcattgaacaacttgatcttcgtcgcaataaagttgtttatcagatttttgctgaagtagaaccagatccagacattacaacagtaatgaaaggaacagatttgatgcgtaccttcaaaccagacactattattgcattaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcaacagaggcttatgtttcacagatggcaaatgattatacagacggacttgctcttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgacgaaaagtatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaagtaacagcagtcgaagaatctcactctattgagtgggatttttagtttcaaaaagattaaccggttaagaatattttcaaaaaattttctgaaaatcacttgacatagtttgtgaagaataatacaatataaaatgtaaacgattacaaaataagatatatttatttctaggaggttttatcatgaaagcggttgttgttaatcaagctagtacaggtgttgaagttgttgagcatgatcttccaaaagttggtcatggtgaagcacttgtaaaagtagaatactgtggtgtatgccatactgatttacacgttgcacatggagatttcggccaggtaccaggacgcattttgggtcacgaaggcattggtatagtagaagaaattggagaaggcgtaacgtctttgagggttggtgatcgtgtctctattgcatggttctttgaagggtgcggtcattgcgaatactgtactacaggacgtgagacactttgtcgtagtgttaaaaatgctggatacagtgttgatggtggtatgagtgaatacgctattgttaccgcggactatgcggttaaggttcctgagggattagacccagctcaagcatcatcaatcacttgtgctggagtaacaacatacaaggctatcaaagaagctggagctgctcctggtcagtggattgcagtgtatggtgcaggtggtcttggaaacttagcagtccaatatgcaaaaaaagtattcaatgctcatgttgtagctgttgatattaacgcagataaacttcaattagctaaagaggttggagcagatttgacagttaatggcaaagaaataaaagatgttgcggcatatattcaagaaaagacaggcggttgtcatggagtggttgtgactgctgtttctaaagttgcgtttaatcaggcgattgacagcgttcgtgctggaggtacagtggtagctgtcggtcttccatcagaatatatggaattgagtattgtaaaaacagtacttgatgggattcgtgtggttggttccttagttggaactcgtaaagacttagaagaagccttcgcatttggagcagaaggcttggtagtaccggtggttgaaaaagtgcctgtggatacagctcctcaagtattcgatgaaatggaaagaggattgattcaaggacgtaaagttcttgactttacaaagtgataatgatgttacgaaccccctttattttaataaagggggttaattatataacgaacaatggacatgttattaaattgtgttacaataactaaaagatatttatataaagagggattcttatggcaatagtatatcaatcaacacgtgatgctagtaataaagtgacagctagtcaagcgattctaaagggattagctgacgatggaggactctttacccccatcacatttccaaaagttgatttagatttcactaaacttaaggatgcttcctaccaagaagtggctaaactcgttttgtcagctttttttgatgattttactgaacaagaattggattactgtattagtcaagcttatgatactaaatttgatacaactgaaatagccccgatagtaaagattggagaccggtatcaccttgaattatttcacggtcctacaattgcatttaaagatatggctttatccattcttccttatttgctaacaacagcagccaaaaaacaaggggttgataataaaatcgttattttaacagcaacatcaggtgacactggcaaggcagcgatggcaggttttgcagatgttccaggaactgagattattgtcttttatcctaaaaatggtgttagttatatccaagaattgcagatgataacacaagccggacaaaatactcatgttgttgcgattgaaggaaattttgatgatgcacagacttcagttaaagaaatgttcaataattcccttcttcgattaaaattatcacagcagcatatgcagttatcatcagccaattcaatgaacatcggtcgccttgttcctcaaattgtttactatatatatgcatatgctcaattagttaagtcaaaggaaatctcaattggtcaaccaattaattttagtgtacctacaggaaattttggtaatattttagcagcatattatgctagtcaaattggattacctgttaccaaactcatttgtgcctcaaatgataataacgttctaacagatttttttaagacacaaacctacgataaaaatcgagaatttaaagtgacatcaagtccctctatggatattttggtctcctctaatctagaacgattaatctttcaccttttaggcgatgatgcagaaacgactaaaaaattaatggaagatttagtgactactggggagtatgccttagaggctaggcaagcaaatattttagagagctttgtagcgggatttgcgacagaacaatttgttgaattagacatcaaacatttatttgaccagtatcagtatatagaggatccgcatacagctgtagcatcagctgtttatcaagcttatcagacagaaactaaagatcaaactccagcagtaattgtgtcaacagcaagtccttataagttcccgtgtgttgttacaaaggctattacaaataaagaagagatacaggatttcgctgctatttcaatcttaaacgatttgtcaggtgtttctttacctaaggcggttacagatctacaaaaggccgaagtaatccatagaacggtagtacctacctcaaatatgcgagaaacggttgaagagtgtctaggtttgaaacaataataaaaatacgattgttttaaaatatttagagcgagaaagaaacattttagaaattttcccatcactctctttttaatgatcctgggtaatagaaaggagatactgtgcgttatagtaaagagattattcagttagctataccagctatgattgaaaatatcttacaaatgctcatgggagtagttgataattatctagtggctcagttaggtgttgtagcagtatcaggtgtttcagttgctaataatataattactatttatcaagctatttttatagctttaggggcgagtatagcaagtctattggccaagtcgttagcaggtagtaagaaggatgatgcaatttcagtatgttctcaagccatttttctaacattactgataggggcagtattaggaattatctcgattgtttttggacaaactttctttaaacttttagggacaacaaaaagtgtcgcacaagttggtggtttatatttagcaattgtgggtggaggtgttgttactttaggaatgttaaccaccctaggctcatttttacgtgtgcaagggcaacctcgtttaccaatgtatgtcagtatttttgtcaatttcctcaatgcagtcttatcaggttttgctatttttgagtggcgctatggtttggtcggagtggcagtatcaactcttatcgcaagattaattggtatttgtatccttgcgaagtatcttcctattaaaaagataataaaaagaatgacttggaaaatcagtgcacaaatttggaatcttgccttaccatcagcaggagaacgtctgatgatgcgagctggagatgttgttatagttgctattgttgttcagttaggtacaaatgttgtagcgggaaatgctattggagaaaccttgacacaatttaattatatgccaggacttggcatcgcaactgctacaattatcctaactgcaaaatatgtaggacaaaaaaacagagaatctatagaagaaactattcaaagttcgtattatattggcttagttctaatgatccttatatcaagttttatgcttcttgcaggcaaaccattgacacagttatttacaaataatccttctgccattaaaggaagtttgattgttattttgctatctttcgtaggagtacctgctactattgggaccttggtttatacagcagcttggcaaggattaggaaatgctaaactcccattttacacaacgactataggcatgtggttaatcagagtagttcttggttatttattaggaatagtttttgaattaggtttgcttggggtttggatggctacgatagcagacaatatctttaggtggctgtttttgaaagttcactatcatcgatatattcaaaaaatgtaaccagaaatggttgcatttttttcgaaaataataaaataatgcttgcgtgtgctgtttttttttgatatcatatactggtgctgtgtatgaacagctttagctatgatgcaagaggttgcgacacgctaggttgcattgccacgcgactcgtgttggttttcttgaggagctagcctattatcgtaaatagacgagaggagaaaagatggcaaacaaaaaaatccgtatccgtttgaaagcgtacgaacaccgtacacttgatacagcggcagaaaaaatcgttgaaactgcaacacgtacaggtgctacagttgctggaccagttccgcttccaactgaacgcagtctttacacaattattcgtgcgactcacaaatataaagattctcgcgaacagtttgaaatgcgtacacacaaacgtttggtagacatcatcaacccaacacaaaaaactgttgatgctttgatgaaacttgatcttccaagtggtgtcaacgtagaaatcaaactttaatttgatttctgagcacaaaaaacgctcgtaaaaaacttttttgagcacaaaaaacgctcataaaaaactttttgaaataaaataagaaaaggaaatattttctcatgacaaaaggaatcttagggaaaaaagtgggaatgactcaaatcttcactgaatcaggcgaattcatccctgttactgtcattgaagcaactccaaacgttgtgcttcaagttaaaactgttgaaacagacggttacgaagcagttcaggttggttttgatgacaaacgtgaagtattgagtaacaaacctgccaaaggccatgttgcaaaagcaaacacagctcctaagcgcttcattcgtgaattcaaaaacattgaaggcttagaagttggtgcagaattatctgtagaacaatttgaagctggtgatgttgttgacgtcacagggacatcaaaaggtaaaggtttccaaggtgttatcaaacgccatggtcaatcacgtggtcctatggctcacggttctcgttaccatcgtcgtccaggttctatgggacctgttgcgcctaaccgcgttttcaaaaacaaacgcttggcaggacgtatgggtggtaaccgtgtaacagttcaaaaccttgaaattgtacaagttatcccagagaaaaacgttgtcctcatcaaaggtaacgtaccaggtgctaagaaatctcttatcactatcaaatcagcagttaaagctgctaaataataagaaaggagaaaacagttaaaatggcaaacgttaaactatttgaccaaactggtaaagaagttagctcagttgagcttaacgaagctatcttcggtattgaaccaaacgaatcagttgtttttgatgttgtaatcagccaacgcgctagccttcgccaaggaactcacgcggttaaaaaccgttcagcagtatctggtggtggacgtaaaccatggcgtcaaaaaggaactggacgcgctcgtcaaggttctatccgctcaccacaatggcgtggtggtggtgttgtctttggaccaactccacgttcatacggctacaaacttccacaaaaagttcgtcgccttgcgttgaaatcagtttattcagcaaaagttgctgaagataaatttgtagctgtagaaaacctttcatttgcagctccaaaaactgctgaatttgcgtcagttctttcagcacttagcattgattcaaaagtacttgtaatccttgaagaaggtaacgaatttgctgcactttcagcgcgtaaccttccaaacgttacagttgctactgcaactactgcaagtgttcttgatatcgttaacgcagacaaacttcttgttactaaagaagcaatctctacaatcgagggggttcttgcataatgaatttgtatgacgtaatcaaaaaacctgttatcactgagaaatcaatggttgctcttgaagcagggaaatatacatttgaagttgacacacgtgcacacaaacttttgatcaaacaagctgttgaagctgcatttgacggagtaaaagttgcaagtgtaaacactgtgacagttaaacccaaagcaaaacgtgttggtcgttacacaggtttcacttcaaaaactaaaaaagctattatcactcttacagctgattcaaaagcaatcgagttgtttgctgctgaagctgaataatctaaggaggaaataacgtgggtattaaagtttataaaccaacgacaaatggccgtcgtaatatgacttctttggattttgcagaaatcactacaaacactcctgagaaatcattgcttgtttcactaaagaataaagcaggacgtaacaacaacggacgtattactgttcgtcaccaaggtggtggacacaaacgtcattaccgtttgattgacttcaaacgtaataaagatggtgttgaagcagttgttaaaacaattgaatacgatccaaatcgtactgcaaatattgctcttgtacactatactgatggtgttaaagcttacatccttgcgcctaaaggccttgaagtaggtcaacgcattatttctggtccagaagcagacatcaaagttggtaacgcacttccgcttgctaacattccagtcggtacagttatccataatattgaattgcaaccaggtaaaggtgctgaattgattcgtgccgctggtgcttctgctcaagtacttggtcaagaaggtaaatatgttcttgttcgccttcaatcaggtgaagtacgtatgatccttggtacttgccgtgcaacaattggtactgttggtaatgaacagcaatcacttgttaacattggtaaagcaggacgtaatcgttggaaaggtgttcgccctacagttcgtggttctgtaatgaaccctaacgatcacccacacggtggtggtgaaggtaaagcaccagttggtcgtaaagcaccatctactccatggggtaaacctgcgcttggacttaaaactcgtaataagaaagctaaatcagacaaacttattgttcgtcgtcgtaaccaaaaataataggttaatagcataatcttatacaaatccgccagctcggtagtacactatagtgtacaggccgttgtggtacattatttaaaggagaaaactacaaaatgggacgtagtcttaaaaaaggacctttcgtcgacgagcatttaatgaaaaaagttgaagctcaagcaaatgacgaaaagaaaaaagtaatcaaaacttggtcacgtcgttcaacgattttcccaagtttcatcggatacacaatcgcagtttatgatggacgtaaacatgttcctgtttatatccaagaggacatggtaggtcacaaacttggtgaatttgcaccaacacgtacttacaaaggtcacgcagctgacgacaagaaaacacgtcgttaataggaggaggacacaatggcagaaattacttcagctaaagcaatggctcgtacagtgcgtgtttcacctcgtaaaacacgtttagtacttgatcttatccgtggtaagaatgttgctgacgcaatcgcaatcttaaaattcactccaaacaaagcagctcgtgttattgagaaaactcttaactcagcaattgcaaatgcagaaaacaactttggtttggaaaaagcaaacttggtagtatctgaaacattcgctaacgaaggaccaacaatgaaacgtttccgtccacgtgcgaaaggttcagcttcaccaatcaacaaacgtacaactcacgtaactgtagttgtatcagaaaaataaggaggtaaaatcgtgggtcaaaaagtacatccaattggtatgcgtgtcggaatcatccgtgactgggatgcgaaatggtatgctgaaaaagaatacgcggattaccttcatgaagatcttgcaatccgtaaattcattaataaagaattagctgacgcatcagtttcaactattgaaattgaacgtgcagtaaacaaagttattgtttcacttcacactgctaaaccaggtatggttatcggtaaaggtggagcaaacgttgacgctcttcgtggtcaacttaacaaattaactggaaaacaagtacacatcaacatcattgaaatcaaacaacctgatttagatgctcaccttgttggtgaaaatattgctcgtcaattagagcaacgtgttgctttccgtcgtgctcaaaaacaagcaatccaacgtacaatgcgtgcaggagctaaaggtattaaaactcaagtttctggtcgtttgaacggtgctgatatcgctcgtgctgaaggttattcagaaggaactgttccgcttcacacgcttcgtgctgatatcgactatgcttgggaagaagctgacacaacttatggtaaacttggcgttaaagtttggatttaccgtggagaagttcttccagctcgtaaaaacactaaaggaggcaaataacaaatgttagtacctaaacgtgttaaacaccgtcgcgaattccgtggaaaaatgcgcggtgaggctaaaggtggtaaagaagtttcattcggtgaatacggacttcaagctacaactagccactggattacaaaccgtcaaatcgaagctgcccgtattgcgatgactcgttacatgaaacgtggtggtaaagtttggattaaaatcttcccacacaaatcatacactgcaaaagctatcggtgtacgtatgggttctggtaaaggggcacctgaaggttgggtagcaccagttaaacgtggtaaagtgatgtttgaaattgctggtgtttctgaagaagttgcacgtgaagcattacgtcttgctagccacaaattaccagttaaatgcaaattcgtaaaacgtgaagcagaataaggagaagacatgaaacttcaagaaattaaagattttgttaaagagcttcgtggattgtctcaagaagaacttgctaagaaagaaaacgaactcaaaaaagaattgtttgatcttcgtttccaagctgcagcaggtcaacttgaaaagactgctcgccttgacgaagttaagaaacaaattgcacgtgttaaaactgtgcaatcagaaatgaaataatagattgggaaaggagaaattctaaatggaacgtaatcaacgtaaaactctttacggacgcgtagtgtctgacaagatggacaaaacaatcacagttgtagttgaaactaaacgtaaccacccagtctatggtaaacgtatcaactattctaaaaaatataaagcacatgatgaaaacaacgttgctaaagaaggcgatatcgttcgtatcatggaaactcgcccactttcagctacaaaacgtttccgtcttgtggaagtagtggaaaaagctgttattatctaatcaaactaaaaggagaaaattgaaatgattcaacaagaaactcgcttgaaagttgctgataatagcggtgctcgtgagatcttgactatcaaagtacttggtggttcaggacgtaaattcgctaacatcggtgacgtaatcgttgcttctgtaaaacaagctactcctggtggagcagttaaaaaaggtgatgtggttaaagctgttatcgttcgtacaaaaactggtgcacgccgcccagacggttcatacatcaaatttgacgacaatgctgctgtaatcatccgtgacgataaaactcctcgcggaactcgtatctttggcccagttgcacgtgaattgcgtgaaggtggctacatgaagatcgtttcattggcaccagaagtactttaatctcagattaacaaacgtagtcccctaggatttcctagggtgcctttcgaggcgtaagaaaaataggagaaaaactcaaatgtttgtaaaaaaaggcgacaaagttcgcgttattgctggtaaggacaaaggcactgaagctgtagttcttaaagctcttccaaaagtaaacaaagttgttgttgaaggcgtagccctcatcaagaaacatcaaaaaccaaataacgaaaaccctcaaggcgctatcgttgaaaaagaagctccaatccatgtgtcaaacgttcaagttcttgataaaaatggtgtagcaggacgtgttggttacaaagttgttgacggcaaaaaagttcgttacaacaaaaaatcaggcgaagtgcttgattaatcacgaaggaaaggagaagcataatggcaaatcgcttaaaagaaaaatatactaatgaagttgttcctgcgttgacagaaaaatttaactattcatctgttatggctgtgccaaaagttgagaaaatcgttcttaacatgggtgttggtgatgctgtatcaaacgctaaaaatcttgagaaagctgctgctgagttagcacttatttcaggtcaaaaaccacttattactaaagctaagaaatcaatcgctggcttccgtcttcgtgaaggtgtagcgatcggtgcaaaagttaccctgcgcggtgaacgtatgtacgaattcttggataaattagtttctgtttcacttccacgtgtacgtgacttccatggtgttccaacgaaatcatttgatggacgtggaaactacactcttggagttaaagaacaattgatcttcccagaaatcaactttgatgacgttgataaagtacgtggtcttgatatcgttatcgttactactgctaacactgatgaagagtcacgtgaattgctaaaaggccttggaatgccttttgcaaagtaatctaggaggtaaataaattggctaaaaaatctatgattgctaagaacaaacgcccagcgaagttctctacgcaagcttacactcgttgtgaaaaatgcggacgtccacactcagtttaccgcaaattccaactttgccgtgtttgcttccgtgacttggcttataaaggtcaagtaccaggcgtaactaaagcatcttggtaataaattaatgatgctttgtgtttaaaaggtgtcgttgataatggcactgatttttaaacgcaaatatactaagacctagtcttacaacgtccgtaaggactcattaattagcaagtgattcaattcaaactgctaataagaggagaattaaaaaatggttatgactgacccaattgcagactttttaactcgtattcgtaatgctaaccaagcaaaacatgaagtgttagaagtacctgcatcaaacattaaaaaagggattgctgatatccttaaacgtgaaggttttgtaaaaaacgttgaagttattgaagatgacaaacaaggcatcatccgtgtgttccttaaatatggacaaaatggtgaacgtgttatcactaacttgaaacgtatttcaaaaccaggtcttcgtgtttatactaaacatgaagatatgcctaaagttcttaacggacttggtattgcaattgtatcaacttctgaaggtcttttgactgacaaagaagctcgccaaaaaaatattggtggagaagtacttgcatatatttggtaaaattttacctaaaatgctcattgagtcacagtataatcctgtgttctcatgagtccccgtgaaaactagttgctcaagcagcttgacaatttaacaggagaaaataaacatgtcacgtattggtaataaagtaattacattgcctgcaggtgttgaaatcattaacaaggataatgttgttactgtaaaaggacctaaaggccaactcactcgtgagtttaataaaaatattggaatcactgttgaagggactgaagtaacagttactcgtcctaacgactcaaaagaaatgaaaacaattcatggtacaactcgtgcgaacttgaacaacatggttgttggtgtttctgaaggtttcaaaaaagctcttgaaatgcgcggtgttggttaccgtgcacaacttcaaggatcaaaacttgttctttctgttggtaagtctcaccaagacgaagttgaagctccagaaggtgttacttttgaagtgccaactccaacaacaatcaacgtaatcggtatcaacaaagaaagcgttggacaaactgctgcttacgttcgtagcttacgttcaccagaaccatataaaggtaaaggtattcgttacgttggtgaattcgtacgccgtaaagaaggtaaaacaggtaaataataggattgatagattttgtagaatcttttctgcaaattctctatcttttcattttaatattgtcattttgacataacaatatatttaagaggtgaaaattgtgatttcgaaaccagataaaaataaaatccgccaaaaacgccaccgtcgtgttcgcggtaaactctctggaactgctgatcgcccacgtttgaacattttccgttctaatacaggcatctacgctcaagtaattgatgacgtagcgggtgtaacgctcgcaagtgcatcaactcttgataaagaagtttctaacggaacaaaaacagaacaagccgttgttgtcggtaaacttgttgctgaacgcgcagtagctaaaggtatttctgaagtggtgtttgaccgcggtggatatctctatcacggacgtgtaaaagctttggctgactcagctcgtgaaaacggattgaaattctaatagggaggacacttaataatggcatttaaagataatgcagtagaacttgaagagcgcgttgttgcgattaaccgcgttacaaaagttgttaaaggtggacgtcgtctacgttttgcagctcttgtagttgttggtgaccgtaatggtcgtgttggttttggtacaggtaaagctcaagaagtaccagaagctattcgcaaagctgttgaagctgctaagaaaaacatggttgaagttcctatggtcggtacaacaattcctcacgaagttcgttcagaatttggtggagcgaaagtattgttgaaaccagctgttgagggtgctggggttgccgctgggggtgctgttcgtgccgtcatcgaattagcaggtgttgcagatattacatctaaatcacttggttcaaacactccaatcaacattgttcgcgcaactgttgagggcttgaaacaattaaaacgtgcagaagaagttgctgctttacgtggcatttctgtttctgacttagcataagaaaggggattataatggctcaaattaaaattactttgactaagtctccaatcggtcgcaaaccagaacaacgtaaaacagttgttgcccttggacttggtaaattaaactcttcagttgttaaggaagataatgctgccatccgtggtatggttaacgctatctctcacttagtaactgttgaagaagcttaattaaatgctaaatcgcactgattgttattggtgcgatttaaacaaatcgtataggcgagtctttgcggggagtaccttttccctcgtaaaggcgttagcattttacaaataaggagaaaaaataatgaaacttcatgaattaaaacctgcagaaggatcacgtaaagtccgcaatcgtgtgggtcgcggtacatcttcaggtaatggtaaaacttctggacgtggtcaaaaaggacaaaaagcgcgtagtggtggtggagtacgccttggttttgaaggtggacaaactccattgttccgtcgtatgccaaaacgtgggttctcaaacatcaatgcaaaagaatatgctcttgtgaaccttgaccaattaaatgtctttgaagatggtactgaagtaactccagttgttcttaaagaagctggaatcgtgcgtgctgaaaaatcaggcgttaaaattcttggtaatggtgaattaactaagaaattgtctgttaaagcagctaaattttctaaatctgctgaagcagctatcactgctaaaggtggttcaatcgaagtcatctaattaatgagaggtaactcattatgtttttaaaattacttagagatgcactcaaagtaaagatggtaagaaataaaattttatttactatctttatccttcttgtatttcgtatcggaacgcatatcacagtaccgggcatcaatgttaagagtttagaacaaatgggtgaacttccatttctaaatatgcttaacttagttagtggtaatgcaatgagaaacttttcggtattctctatgggagttagcccttacattactgcgtctattgttgttcagttacttcaaatggatattcttccgaagtttgttgaatggggaaaacaaggagaggtaggtcgtcgtaagcttaaccaagctacacgttatatttctttgttccttgcattcgtacaatcaattggtattactgctggttttaacactctatcaagtgttgctttagttaaaactccgaatgtacaaacatatttgcttattggtgcaatccttacaacaggtagtatggtggttacttggctaggtgaacaaattactgataagggattcggaaatggagtgtctatgattatctttgcgggtatcatttcttccattccaagtgcaattacaactatctacgaagatttctttgtaaatgtacgctcttcagcaattacaaattcttacatctttgtcgggatccttatcgtagcagtattagcaattgtattttttacaacatttattcaacaagctgaatacaaaattccaatccaatatacaaaacttgttcaaggagctcctacaagttcatatcttcctctaaaagtaaatccagctggtgttattcccgttatctttgctagctcgattacaacaattccaagtacgattattcctttctttcaaaatggcaaagaaattccttggcttactaaactccaagaattacttaattatcaaaccccagtcggtatgattatctatgctatcttgattattctgttctctttcttctatacttttgtacaagtaaaccctgaaaagacagcagagaatcttcaaaaaaattcgtcctacattccaagtattcgaccaggacgagaaacagaagaatatatgtcatcgctattgaaaaaattagcaacaattggttcagtatttctagcatttatttccttgttaccaattattgctcaacaagcgttgcatttgtcatcaagtattgcgttaggtgggacaagcttactcattttgattgcaacgggtattgaaggtatgaaacaactcgagggctatcttttgaagagacgctatgttggattcatgaatacaacagaatagaatataggttgactctgtcaaccttctattttgttttttaataagtccgacatgctgtgttggatttatttaaaaacaaaataaggagactataatgaatcttttaattatgggtttgcctggtgctggtaaaggtactcaagcagctaagatcgttgaagaatttggtgttgctcacatctcaacaggggatatgttccgcgccgcaatggctaatcaaaccgaaatgggacgtttagctaaaagttatattgataaaggtgaattggttcctgatgaagtaacaaacgggattgtaaaagagcgcttagctgaggatgatatcgcagaaaaaggttttttacttgatggatatccacgtactattgaacaagcacacgccttagatgctacgcttgaagaactaggactacgcttagatggtgttattaatattaaagtggatccatcatgtcttatagagcgtttgagtggtcgtattatcaatcgtaaaactggtgaaactttccacaaagtgttcaacccaccagtagattataaagaagaagattactatcaacgtgaagatgataagcctgaaactgtcaaacgtcgcttggacgttaatattgctcaaggagaacctattcttgaacactatcgtaagcttggtcttgttacagatattgaaggtaatcaagaaataacagaagtttttgcagatgttgaaaaagcgttgctagaactcaaataaattatgctaatctacttgcataagtagattagtaatgatatactaagttagtctgacttataattgttacctctttatagaggacatcaaatcgaaatttagggggtacttttgcgtggcaaaagaagatgtgattgaaattgaaggtaaagttgttgaaactatgcctaacgcaatgtttactgttgagttggaaaatggacaccaaattttggcaactgtatcaggaaaaatccgtaaaaactacatccgtattttggtaggtgatcgtgttactgttgaaatgagcccatacgatttaacacgtggacgcatcacataccgctttaaatagtcgaaataattggagggattaaaacatgaaggtaagaccatcggttaaaccaatttgcgaatactgtaaagttattcgtcgtaacggtcgtgttatggtaatttgtccgacaaacccaaaacacaaacaacgtcaaggataatatagaaaggagataaaatggctcgtattgctggagttgatattccaaatgacaaacgtgtagtaatttcacttacttatgtatacggaattggtctttctacatctaaaaaaatcttagcagctgcaggtatttctgaagatatccgcgttaaagatttgacaccagatcaagaggacgctatccgtcgtgaagttgatgcaatcaaagttgaaggtgacctacgtcgtgaggtaaacttgaatattaaacgtttgatggaaatcggttcataccgtggaatccgtcaccgtcgtggacttcctgtccgtggacaaaatactaaaaataacgctcgcactcgtaaaggtaaagctgttgcgattgcaggtaagaaaaaataaaataggaggtaaaacaattggctaaaccaacacgcaaacgtcgtgtgaaaaagaacatcgaatctggtgttgctcatattcacgctacattcaataacactattgttatgattacagatgtgcatggtaacgctcttgcatggtcatcagctggtgctcttggatttaaaggttctcgtaaatctactccatttgctgctcaaatggctgctgaagctgctgctaaatctgcacaagaacacggtcttaaaactgttgaagttactgtaaaaggtcctggttcaggtcgtgaatctgctatccgtgcccttgctgcagctggtcttgaagtaactgcaattcgtgatgtgactcctgtaccacataatggtgctcgtcctccaaaacgtcgtcgtgtataatcatagcattttatagtacacaacttttcgtttaagagggagtaactaaatgattgagtttgaaaaaccaataataacaaaaattgatgaaaataaagattacggcagatttgtcatcgaaccactagaacgtggctacggtacaactctaggaaactctcttcgtcgtgtgcttctgtcttcacttccaggtgcagcagtcacatcaatcaaaattgatggagtattacacgaatttgatactatcccaggtgtacgtgaagatgtgatgcaaatcatccttaatgtaaaaggacttgctgtgaaatcttacgtcgaagacgaaaagattatcgaactagacgttgaaggtcctgcagaaattactgccggagatattttaacagatagtgatatcgaaattgtaaaccctgaccattatcttttcacaattgctgaaggtcacagtttgaaagcaacaatgacagttgctaaaaaccgaggttatgttccagcagaaggaaataaaaaagatgatgcaccagtgggaacattggctgtagattcaatctatacaccagtgaaaaaagttaattatcaagttgaacctgctcgtgtaggtagtaacgatggctttgataaattaactattgaaatcatgacaaatggcacaatcattcctgaggatgctcttggtctttcagctcgcgtcttaattgaacacttaaacttgtttactgatttaacagaggttgctaaagcaactgaagtaatgaaggaaacagagaaagtgaacgatgagaaagtgcttgaccggacaattgaggaacttgatttgtcagtgcgctcatataactgtttaaaacgtgctggaattaatacagtatttgatttaacagaaaaaactgagcctgaaatgatgaaagtccgaaacttaggacgtaagagtcttgaagaagttaaaatcaaacttgccgatctaggtcttggattaaaaaacgataaataaaataggaggacataatggcttaccgtaaactaggacgcactagctcacaacgtaaggcaatgcttcgtgatttgacaaccgatcttcttatcaacgaatcaattgtaactactgaagcacgtgctaaagaaatccgtaaaacagttgaaaaaatgattactctaggtaaacgtggtgatttacatgctcgtcgtcaagctgctgcttatgtacgtaatgaaattgcatcagaaaactatgatgaagcttctgataaatatacatcaacaacagctcttcaaaaactttttgacgacatcgcacctcgttatgctgaacgtaacggaggatacactcgtattcttaaaacagaaccacgccgtggcgatgctgccccaatggcaattattgaattagtataatttttatcaattttgttgagtgttatgatgatggaatcaatcgattcttagtctagctctggtctaccgctgagaattattctcagcgggaacactcatcatatattgttaaataggtaacgcttgtttacgaaatgcaaacaattttgtttatatttcgtaagcaggcgttttatgcattattatatttattggatattttcgatgagcaaagaatttaatcgctagactacatttctcaatagtggttatataatttctcttaattgaatatagaggaatagttatgtctatactaaatttataaaatacaaaaatagtattgacaggaagtagaaatatttagtataatgaataagttgtctcgagagagcagtttctattagcgcgtagttaacaacttaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgtagactcgttagctcagttggtagagcaattgacttttaatcaatgggtcactggttcgagcccagtacgggtcatttagaaatgcgggtgtggcggaattggcagacgcaccagatttaggatctggcgcttaacggcgtgggggttcaagtcccttcacccgcattagtagattgccggcttagctcagttggtagagcatctgatttgtaatcagagggtcgcgtgttcaagtcatgtagccggcattaactttataattttagaagttattttgggcgcgtagctcaggtggttagagcgcacgcctgataagcgtgaggtcggtggttcgagtccactcgtgcccatcaagaatatggtccgttggtcaaggggttaagacaccgccttttcacggcggtaacacgggttcgaatcccgtacggactattttttgttatatggaggattacccaagtccggctgaagggaacggtcttgaaaaccgtcaggcgtgtaaaagcgtgcgtgggttcgaatcccacatcctcctttaaagatatcgcgggatggagcagctaggtagctcgtcgggctcataacccgaaggtcgtaggttcaaatcctgctcccgcaataggctcggtagctcagttggtagagcaatggattgaagctccatgtgtcggcggttcgattccgtctcgcgccatttataccttaggagagatagcgaagaggctaaacgcggcggactgtaaatccgctccttcgggttcgggggttcgaatccctctctctccatagtaaacgggcatagtttaaaggtagaactaaggtctccaaaaccttcagtgtgggttcgattcctactgcccgtgttttttctaatatggcgggtgtggtgaagtggttaacacatcagattgtggctctgacattcgtgggttcgattcccatcactcgccttttcatggggtatagccaagcggtaaggcaagggactttgactccctcatgcgttggttcgaatccagctaccccagttttaagatagccggcgtggcggaattggcagacgcgctggactcaaaatccagtgtcctcacggacgtgccggttcgaccccggccgccggtatatttataaagacaaggtttagaagccttgtcttttttgtattgtgctggtaattttgagaaaaagttactgaaaattacttatatttgtttttcattattgcaatcgttatagaaggtttaaaacaagcagaaataataaggaaatttttcaagagttagtggagactcaacatttaaatgaaattcaaagaggactcctaaatgtcataggttctgaagtaataaaagtgtttgtgaatgatagataggtagtataaaataataagatttttcagtgtatatgttacgactaaaaaattaaactcgtgaaaatttgttatactaatattagttttaacatactggtaaataataattatttttattagatacttgacatgggaagtttattttctaagaaaagagagcatgttgaaaaaatatgtaaaatggttaattcccatatctattattgggatgttactagcaggctgtcaaatgaatagtgaatctaaaagtcagtcaaacgaagtaaaaaatagcaaacagtcagcagtaaagaaaggtaaaaaagtaataaaaaaagaacaagtagcttatctcaaaaagcatgaaaaagaattaactgaatatgtcaaaatccagatattagtgaaattaagtatgattggaatagtgtgcgcatagtggaagctagtagtggaacccctcaaggcggagagcaactattattaattttgggttatgcaaatggcagtgaattaaccaattttactctaaatttcacattgggtgataatcaaatgcctaatattgactcagttggctcagataatttatcaactattgaagattaataataacaataagaaaggtatataatgggatgatggaatcttaaggaatttgaagatatattttgaagtatggcagaaagtgctaatacaggtcgatcgaattcttttgttttagaagaattaactgaatttcaaagagaaaagttaaaaaatggggagtcagttaagtttaatttttctaaagatgttaagaaagaaaataaggttatcgaaggagggcacccccaagtcatagggtaatctacctgcaaactggataagtccttaaatacaattgatgaaaaagtagaggttcgcgttcctgatgtcaatggcggttatcactctgagcattgtgttactaattcctatcagaaaggttactgaaagatgatgaagcagtaactctataatcactaaaagctcatcattgcttagtgtttaagttaacttctaaagctcaaaccttgttaaatcaaggtctgtttgcttttaaaagtgacatgttatttttctaaaaatgagattattgggattcctcattctaagttactttgtttatatgtacctttacttaaggtttattttcattatttttaatttaatattttggagtatgtatgctccattatagtattttcgaagacatctttaaaaggactgtagaagttaaaatattttaacctagtatctaacgtcatatattggtacatagttttaagtatccttttgataaccttgtacatatgaaataggctagatatttttagtgaactaaatgtaagtttattgcttgtattaggcgggataacaatattgttgtttttattctttctgagtaatggtttattaatcatgtaattattctggtatcaaatgatacttttaatattccagtttgtcaataaatcatcaatgtaattcttttcatcaaaagcgatccctttatctagttgatttaatatgttaacttgatgattgttcttcttgcttaatatatgggataataattatcttaaattgacacttggagcattcaatcacgtgatgtaataactaaaaattgtttaaaatttaaggatgtatttcttgttgatcttactatctgatctaataatagtatataataagattaaaatttaaacattgtctggagatgtagcaaaggagataaaatgactaaaatttatcatatgattttatgtaattctgatataatgaagattttagctataataaaatctcttccactgaatgattgttggctgtgtgctggcacattgagaaactttgtatggaataaactttctggaataaatgagacattgacatcagatattgatgttgtattttttgataaaaatatttcttatgaagaaacggtggtattagaacaacaattaaaggataactatccacagtacgattgggaacttaaaaatgaattttacatgaacactcattctcctaataccccaaagtatactagctctaaagatgctatttcaaaatttcctgaaaagtgtactgcagtgggagcaaggttagatgatagaaatcaactcgaactttacctcccttatggtgaagaggaaatattaaatttcattgttagtcctacgccatattttgaagaggatctattacgttataatgtttatttgaagcgagtggataagaagaaatggaataatatttggcctcgtttaacaatcataaaaaaatgataacgttactggagttggcttaacagcttttaaatttttagactgacaaatagtatagacctttaataaggtcgtttatcgataatcatagtgtactgtgttataatcgttatagcataaaaacacgttgcagttggtagtctgcaagcgttcagtgaacgtcagtaaccttccctccaggtcgtccattgcaatttaatatttaaaggagggggctgtatgaaaatgacagtctattttgatggtaatttttggttgggtttgattgagtacgatgatgatggtgattacaaagtttttcggtatttttttggaaaagaacctaaagatgatgatgtttttaattttataaatcataaacttaatgatttgataaaaaaatatgagtttgttaaaacggatatttctctaaagcgtacgaatgaacacaaaaaaagtcctaaaagaatgcaaagagaaattaatagagaaaaacgtaagccagtagtatctacaaaagcgcaattggcgatgaaaactattcatatgagtataaaaaacgaacgtcaattaagtcagaaatgtaagaaaaatgagttaagaaaacatcggtaccaattaaaacaagaaaaacgttaccaaaagaaaaaaggacattgattgtgtcatcatataaaaagcttgagagtgtcatctcaagctttttatatgttaactaatatgagtcactaaatagtctgataatgctcaattaatgtgttttgggaaaaaatcatttccttaaaggacaccattgtcatgttgttatcaccttactttttttatacttagtatatgtttaagaaaggaataagttgttttgagagattttgaggagttgtttgataaagtaaagccaatcgtaatgaagctgagaagaaattattttgttcaactttgggaatatgatgattggattcaagaaggacgtattgtactttttaggttgcttgaagagcatccgtatttattggataatgaaagcaaactattcatttactttaaaacaaaattttcaaattatttaaacgatgtattaagacaccaagattgtcaaaagcgacaatttaataaaatgccttatgaagaaataagtgaagttagtcactatgttaagagtaaaggactagttttagatgactatattgcttatcgtgatactttaacaaaagtggaagaaactttgtcagatattgataaagaaaaatttgaaaaactgattagtggtgaacgttttgcggggaagaaacaattcatacgagatattcaaccctttttcaatgcttttaaagcggattaatcgattttatttctgcagtagatagctgcagaatttttttatagggaaagttcgctgatatattcctgtgaaagcctttgttttttgttataatataataaaatgcttgtgaggtgtcagtatgagtaaagttcgtttatatatcgctcgtcatggtaaaacaatgtttaatacaattggtcgcgctcaggggtggagtgatactcctttaactacttttggagaactcgggattaaagagcttggtttgggactaaaggcttcaaatattagttttaaagaggctttttctagtgatagtggacgtactttacaaactatggaaattattctcagggaagtgcaacaagaaaatattccctatacgagagataaacgaatccgcgagtggtgctttggtagtttggatggaggatatgatggcgacctttttaatggcgttctgcctcgagtttcaaacggagatatgagccatttgacacacgaagaaattgctaatttgatttgtcaagttgatacggctggctgggcagaaccgtgggcaatattgagtaaccgtattctgtcaggcttcactgctatagctaaaaaaatagaggatattgggggaggtaatgcgattgttgtcagtcatgggatgactattgcgacttttttatggttaatcgaccatagtacccctcgtagtttaggcttagataatggtagtgtctcagtcgttgattttgaagatggaacattttctattcaatctattggggatatgtcctatcgagaaaaaggaagagaaattttagaaaaaacattgcaatgaaaaaaaataaaattatccgattcagtttagttggtgttctacttgcgatactatgctttagtctttttgctttattgaagcctaacagtcaacaatcatcatctcaaaagttgaggaatgaggatataaaaaagatatcctctcaaaaaagaaataagaaattacaattaccagctgtatcatcaaaagattggaacttgattttggtcaatcgtgaccataaacatgaagaattaagtccagatgtggttcctgttgaaaatatttatttggataaacgtattacgaagcaagctactcagtttttagaggctgctagagcaattgattcacgagaacatttaatttcgggttatcgtagtgttgcctatcaggagaagttgttcaattcttatgttactcaagagatgactagtaaccctaatttgacgaggggacaagcagaaaagttggtaaaaacttactctcagcctgcaggtgctagtgaacaccagactggattagcgatggatatgagtactgtagattctttgaatgagagcgatcctagagtagtcagtcagttgaaaaagatagctccacaatatggttttgtcttacggtttccggatggtaaaacagcagaaacaggggtaggttatgaagattggcattaccgctatgttggggtagagtctgcaaaatatatggccaaacatcatttaacattagaagaatacataactttattaaaggagaataaccaatgaggaaacgtttttccttgctaaattttattgttgttacttttattttctttttctttattctttttccgcttttaaaccataagggaaaagtagatgctaattctaggcagagtgttacctacaccaaagaagaatttatacaaaaaattgtgccagatgcgcaagatctaggaaagtcgtacggtattcgtccttcatttattattgcacaggcggctttggattctgatttcggagagaaaatattagctaataagtatcataatctgtttggtttgcttgcagaaccaggaacgccctcaattaccttaaatgatagtagtacaggaaaaaaacaggaaaagcaatttactcattataaatcttggaagtattcaatgtatgattaccttgctcatataaaatctggagcgacaggcaaaaaagattcatatactataatggtgtctgttaaaaatccaaaaactttagtgcaaaaattacaagatagtggttttgataatgacaaaaagtacgctaaaaaaatgacggaaatcattgatttgtatgatttaacaagatatgataagtgatattagcactctttgaataagagtgctaatttttgatgttttttccttgactatcttttaaaaaggagtataataaaatcatagttagcagtcgatgtgtaagagtgctaatttcagaaagaccgagaggggtgatgtttttgtgattacacaacgtcaaaatgatattttgaatttaatcgttgagttatttacacaaactcatgaaccagtagggtctaaagctttacagagaacgattgattctagtagcgccactattcgtaatgatatggcaaaactagagaagttggggttattggaaaaagcacacacttctagtggacggatgccgagtccagctggttttaagtattttgtagagcactcccttagactagatagtattgatgagcaagatatttatcatgttataaaagcttttgactttgaagcattcaaattagaagacatgcttcaaaaagctagtcatattttatcggagatgacgggctatacatccgttattttagatgtggagccagctcgtcaacgtttgacagggtttgatgttgttcagcttagcaaccatgatgctctagcagtcatgactttagatgaatctaagccagtgacagtgcagtttgctattccaagaaactttttgacacgtgacttgatagcatttaaagctatcgtagaggagcgcttgctggatggtagtgtcatggatattcattataagttgaggacagaaattcctcagatcgttcagaagtattttgtaactacggataatgttttacaactatttgattatgttttttcagagctgtttctggaaacggtatttgtagctggcaaggtaaattctttaacgtattcagatctatcaacgtatcagtttttggataatgagcagcaagtagcgatttctttgaggcaaagtctgaaagagggtgagatggcttctgtccaagtggcagatagtcaagaagccgcacttgcagatgtgtcagttttaactcacaaatttttgattccttaccgtggatttggactcctgagtttgattggtcctattgatatggattatcgtaggtctgttagtttggtaaacattatcggaaaggtattggctgctaaattaggtgattattatcgatacctaaattctaaccattatgaagttcactgataatggcagtattcaataagttatttaaaaggaggcactcagtgtcagaagaaattaaaaaagacgatttacaggaagaagtggaagccactgaaactgaagagacagttgaggaagttattgaagaaattcctgaaaaatcagagttagaactcgcaaacgagcgtgctgatgagtttgaaaataaatacttgcgagctcatgcagaaatgcagaatatacaacgtcgctctagtgaagaacgtcaacaacttcaacgctatcgttctcaggatctggcaaaagcaatcttaccatcgcttgacaatctagaacgtgccttggctgttgaagggttgacagatgatgttaaaaaaggtttagaaatgactcgtgatagccttattcaagcactaaaggaagaaggcgtagaagaagtagaagtcgactcatttgaccacaactttcatatggcagttcagactctcccagccgatgatgaacatccagccgatagcattgcagaagtctttcaaaagggatataaattgcacgagcgtctgctaagaccagcgatggtagttgtctataactaaggtaaatgagttttcgtttttgtccgtaatgacagtaaactagatagcaagttagaagctattcagcttgctgattaaactatagtgattgcttagaattggaagtaaaataattcgagtgcttactaagataaattgaaataaaaagtaataaagtattataaaataagaggtattaacatgtctaaaattattggtattgacttaggtacaacaaactcagcagtagcagttcttgaagggactgaatcaaaaatcattgctaacccagaaggcaatcgtacaactccttcagtagtatcattcaaaaatggtgaaattatcgtgggtgatgctgcaaaacgtcaagcggtaacaaatccagatactgttatctctatcaaatcaaagatgggaacttctgaaaaagtttctgcaaatggtaaagaatatactcctcaagaaatttcagcaatgattcttcaataccttaaaggttatgctgaagactatcttggagaaaaagtagaaaaagcagttattactgttccagcttacttcaacgatgcacaacgtcaggcaactaaagacgctggtaaaattgcaggtcttgaagtagaacgtatcgttaacgaaccaacagcagccgcacttgcttatggtatggacaagactgacaaggatgaaaaaatcttagtttttgaccttggtggtggtacatttgacgtatcaatccttgaattaggtgatggtgtcttcgacgttcttgcaacagcaggtgataacaaacttggtggtgacgactttgaccagaaaattattgatttcttggtagaagaattcaagaaagaaaatggtattgatctttctcaagacaaaatggctcttcaacgcttgaaagatgctgctgaaaaagctaaaaaagacctttcaggtgtaactcaaactcaaatttcattaccgttcatcactgctggttctgctggtcctcttcacttggagatgagcttatcacgtgctaaatttgacgatctcactcgtgaccttgttgaacgtacgaaaactccagttcgtcaagctctttcagatgcaggcttgtcattgtcagaaattgatgaagttatcctcgttggtggatcaacacgtatcccagcagttgttgaagctgtaaaagctgaaactggtaaagaaccaaataaatctgttaaccctgatgaagtggttgctatgggtgctgctatccaaggtggtgttatcactggggatgtgaaagacgttgtacttcttgacgtaacaccattgtcacttggtatcgaaacaatgggtggtgtcttcactaaattgatcgaccgcaacacaacaatcccaacatctaaatcacaagtcttctcaacagcagcagacaaccaaccagccgttgatatccatgttcttcaaggtgaacgcccaatggcagcagataacaaaacactcggtcgcttccaattgactgatatcccagctgcacctcgtggaatcccacaaattgaagtaacatttgatatcgataaaaatggtattgtatctgttaaagctaaagatctcggtactcaaaaagaacaacacattgttatccaatctaattcaggattaactgatgaagaaattgataaaatgatgaaagatgctgaagcaaatgctgaagcagatgcaaaacgtaaagaagaagttgatcttaaaaatgaagttgaccaagccatctttgcaacagaaaaaactattaaagaaactgaaggcaaaggctttgatacagaacgtgatgcagcgcaatcagcacttgatgagttgaaaaaagctcaagaatcaggtaaccttgacgacatgaaagctaaacttgaagctcttaacgaaaaagcacaagctcttgcagttaaactttacgaacaagcggctgcagcacaacaagcagctcaaggggctgaaggtgcacaatcagctgattcatcaagcaagggtgatgatgttgtagatggcgaattcactgagaaataattattaatattgttcagattcatttgaatataagcatgaaaactatactagcatagtaaagttcttcgtgataggggttgctcaataatctagataagtttcagattacataagctaatttcgctatcactaaataaaaacatattaataataaataggcggggcgcctcgctccgtctgttttattaagtgtcatatatatgttaactatttagagctgtaactgggcaagaataattgttaatctcttcaagtgtagtatatgaacaaaatataaaggattagataatgaacaatacagaattttatgatcgtcttggcgtttcaaaagatgcttctcaggacgaaataaaaaaagcttaccgtaggatgtctaagaaataccatccagatattaataaggagacgggagcagaggaaaaatataaagaggttcaagaagcttatgaaaccttgagtgatacacaaaaacgtgctgcctatgatcaatatggcgctgctggggcaaatggcggttttggtggcttcgatggtggcggttttggtggcttcgatggtggtggctttggtggttttgaagacatcttctcaagcttttttggtggaggagggatgcgcaatcctaatgcaccacgtcaaggagatgacctacaatatcgtgttaatttaagttttgaagaagctatctttggagctgaaaaagaagtatcttataatcgggagtcatcatgtcatacttgttcaggaagtggagctaagccaggtactagccctgtgacttgtcaaaagtgtcatggttcgggtgtgattaatgttgatacacaaacacctctaggaacaatgcgtcgccaagtgacttgtgatgtttgtcagggtagtggtcaagaaatcaaagagaaatgtccaacatgtcatggaactggtcatgagaagaagacgcataaagtatcagttaaaatacctgcaggagttgaaactgggcaacaaattcgtttaacaggacaaggtgaagctggcttcaatggtggtccttatggtgatctctttgttattattaacgttctcccaagccaacagtttgagcgtaatggatcaacaatttattatactttgaatattagctttgtccaagctgctttgggtgatacaattgatatacctactgtccatggagcggtagaaatgtcaattcctgctggtactcagacaggaaaaacgtttcgtcttcgcggaaaaggtgcccctaaacttcgagggggtggacaaggtgatcagcatgttactgttaacatcgtaactcctactaaattgaatgatgctcaaaaagaggcattgcacgcttttgcagaggcaagtggagataagatggtacatccgaagaagaaaggtttctttgataaagtcaaagatgctttagatgttgattaaaaaataaaagtctagaatcgaaagtattctagacttttttgtattgctagagggattgcttgaacctaaattttacagtacaatgaatctaatattgtagggggacaatttttatggtaaccaaagttgaagagattcgctcatatttgatagcttctatacaaaatggtaagttggctccaggagatcgcctaccatctataagacagttagctaatcaattttcctgtaacaaagatacagtccaacgagttttgatggaattgcgttttgataattatatctatgcaaagcctaggtcaggctattacgtctttgattctcatcaagaggaagttgaagaaggggttagtttaccaaactctgagattgcaaatatagcttatgatgattttagattgtgtttgaatgagacccttattggtagggaagattaccttttcaattattactatcgtcaagaaggtcttcttgatttaagtaaagcagtggctaaattaatggaagaaacaggggtctatgttccccttgatgatattgttattacggctggtactcaacaggcattatttattttgacacaggttacctttccaaatcgaaaatctcgagttttaatagaagaaccgacctatcctcgtatgattgaactaatcaaaacacaaaatttaccctatgaaactatttctcgaggtactcatggaattgattttcagcgtttagaggagattttccagacacaatcaattaagtttttttatgttatacctcgcatgcataatcctttgggaacatcctataatccggtagagatgaaaagattaatagagatggcagagaagtatgatgtttatattgtggaagatgactatatgtctgattttgcaagtcagtcaccattacattattatgatactcacgggcgtgttatttatctaaaatctttttcaaaggctattttccctgctttaagattagctgcgatttgtttaccacaagctttaaaatcaacatttatggcttacaagaagttgatggattatgatactaatctgattttacaaaaagcattagcgctttatattgaaaatggcctttatgctaagaatagtcaatatttgaaatatcgttatcagaaagaccttgcaaattcaaaatctattttagctgatcaccctaatctaccctcatatagtttacatcacgatagtgtattatttgattgttcgaaactcgataactttaaaatattacggcaatacggcgatactttggaaaattatttttgtcaaaaatcgcatcaatctctcttacaagtaaaaaatgattcctgcttaaagcagttcttgggatcgttgtagtataattgtagggggacagtttaaaatagataatatagttttcataaatgaaaggtggtaaaataaacccatgacaaggtataaggcacagatttcttatgatggttcagctttttcaggcttccaaagacaaccaaattgtaggacagttcaagaagaaattgagagaactcttaagcgcctaaatagcgggaacgatgtgataatccatggtgctggtcgcacagatgttggtgttcatgcttatggacaagttatccattttgatttaccacaggcgcgtgatgtagaaaaattacgctttggtttagatacacagtgtccagacgatattgatattgtcaaagtagagcaagtgtctgatgattttcattgtcgatatgataaacacattaaaacttatgagtttttagtggatatcggtaggccgaaaaatcctatgatgagaaactatgcaacacattacccttatcctgtcattattgagcttatgcaagaagctattaaagatttagtaggtacccatgactttacaggctttactgcttcaggtacgagtgtagaaaataaagtacgtactatttttgatgcgaaaattcagtttgaagcgtctaaaaatcttttaatttttacctttacaggaaatggttttttgtataaacaggtgcgtaatatggttggtaccctgctaaaaattggtaatggacgcatgcctattagccaaatcaaaacaattttacaggctaaaaatcgggatttagcaggtccaactgcggcaggaaatggtttatatttgaaggagattatttatgaagacgaggaatgttttagcaatttcaggaaatgatattttctctggcggcggcttgcatgcagatttagcaacttacgttgttaataaattacatggttttgtggcagtaacatgcttaacagcaatgtcagataaagggtttgaagtcattcctatagaggcatctatactaaagcagcaactagaaagtttaaaagatgtagagtttgggtctattaaactaggattgcttcccaatgtagaaacagcacaagttgttttggaatttgtaaaatcaaaacaagaatgtccagtagtcttagacccagtcttagtttgtaaagaaaatcatgatttagaagttagccaattacgtgagcagctaattgcgtttttcccatatgctgatgtgattactcctaatttagtagaggctcaattattgacgggtctttcgattgaaaacttagatcaaatgaaaattgctgctgagaaactttacgatatgggagctaaacatgttgttatcaaagggggcaaccgtttaaatgctgaagaggctacagacctttactatgatggtgaacgttttgaaacctatgtttttcctgtagtagatgccaataatacaggtgctggatgtacatttgcgtcaagtattgccagccaattagctatgggtaaaaatgtagaagatgcagtcaaaatgtctaaaggtttcgtctatcaagctattaaagcatcggataagtacggagttgtccaacatttttaggagattttaatgaggaaagagaaaactagtcaattggttcaattggcaattgtaacagctatatctattgtattggggatgtttataagtattccgacaccaacaggttttttgacattactagatgctggaatattctttgctgccttttactttggcaaaaaagaaggggctgtggtaggtgccttagctggttttttaattgatttattgaaaggttatcccaattggatgttctttagtttattgattcatgggacgcaagggtatttagcgggtttaccaggtagaagacgtcttttaggtcttattagtgcaactcttgttatggtattaggttatgctatagctagtggattgatgtatggttggggagctgttctaccagatattcctggcaatattatgcaaaatatggttggtatggttgttggttttgctcttaataagtctctagaaagagtgaagaaatgatactagattataataagttaaagcaggaaactaaagctattgtagttgatattattgaacgtagcgctcttaaaaaaggtcaaatttttgtactaggtctatcatctagtgaggtttctggtggtttaattggaaaaaattctagttctgaaattggtgaaattatcgttgaagttatcctcaaagagttacattcacgcggcatctatttagcagttcaaggttgtgaacatgttaatagggcgttggttgttgaagcagaattggctgaacgtcaacagttggaagtcgttaatgttgttcctaatctacatgctggcggtagtggtcaggttgcagcttttaagttgatgacatcaccagttgaggttgaagaaattgtggcacatgctggaattgatattggagatacttctattggaatgcatatcaagagagtacaagttcccttgattccaattagtcgtgagttgggaggagcacacgttacagcactagctagtcgtcctaaattaattggcggtgctagagcaggatatacgagcgatccaatccgtaaattttaaaataaacctctgctctgcagaggtttattatttatctcaacgagagtggttattggagaaattgtacgttggtaagtcaataccttcttcaagaatagctttttgataaagtttgtaaaattcagcatagatgtcaaactgagcaccgttttgcgtgaagatattaatacgataaacaaattgaccattagcattggttgtaggaccaaaaacagtaggctctccaacgatagcagggtgttttgaaacatactcttcattgatttttgttacaatatcagaaatctgatcaaggtttgtatgaacaaataaaggaatatcaatttgagcacgcatattgctacgagacttattgctgacaattgtaatattacgattaggaatgaagtgcaaggttccatcgaaatcatgaatttgtgtggtgcgtatcccaacattagtaacagtgcctgatacagtaccaacattaataatatcaccaacatcaaattggttttctagcagaataaaaaagccattgacaacatctgataagaagccttgagcaccaagtccaatagcaaccccagcaataccagccccagctaataaactagaaattggaacgcccaatatacttaaaatccaatagaatagaaagaaataaagggtatagtttaaaacattgtgagaaagtttagctaatgttttttgacgagctactttttgtctagaaaaggcgagtgagcgattaacagtcttttcgaaaagataattgatgacttgcctaacgataacgaatgcaatgattaataataagattgatattagtttggtgaagaaagtaaataaaacttcctctacattaagatggtctataaatttttctaaagtaatcatagtaatagtctagtaaaaaaaaagccatagagcaagtattttaaaagcttatcgttaagcagtttaaagcttcttttttgcataaaaactttgtaaaacgttttaaattatggtaaactaaactgtatctaaataattttaaggagaaatgacttaatgtctacatcatttgaaaataaagctacaaaccgtggtattatcacatttacaattagtcaagatgagatcaagccagctcttgatcaagcattcaacaaagtaaaaaaagatttgaacgttccaggattccgtaaaggacatatgcctcgtacagttttcaaccaaaaatttggtgaagaagcactctacgaaaatgcattgaatttagtgttgccaaaggcttacgaagcagctgttgcagaacttggtttagacgttgttgctcaaccaaaaattgatgttgtatcaatggaaaaaggtcaagattggaagttgacagctgaagttgttacaaaaccagaagttaaacttggagattacaaagacctttcagtagaagttgatgcttcaaaagaagtttcagatgaagaagttgatgctaaagttgaacgtgagcgtaacaaccttgcagaattgactgttaaagatggtgaagcagcacaaggtgatacagttgttattgactttgtaggttcagttgatggtgttgaatttgatggtggtaaaggagataacttctcacttgaacttggttcaggtcaatttatcccaggatttgaagaacaattagtaggttctaaagctggtcaaactgtagacgttaatgtaacattcccagaagattatcaagcagaagatcttgctggtaaagatgctaaatttgttacaacaattcacgaagtaaaaactaaagaagttccagcacttgatgatgaacttgcaaaagatattgatgatgaagttgaaacacttgatgagttgaaagcgaaatatcgcaaagagctagaatcagcaaaagaaattgcatttgatgatgcagttgaaggtgcagcaatcgaattagctgttgccaatgcagaaattgttgaattaccagaagaaatggtccatgatgaagtacatcgtgctatgaatgagttcatgggtaatatgcaacgtcaaggaatttcaccagaaatgtacttccaattaacaggtacaactgaagaagaccttcataagcaataccaagcagatgctgacaaacgcgttaaaactaaccttgttatcgaagcaattgcagctgcagaaggctttgaagcaacagatgaagaaatcgaaaaagaaatcacagatcttgcttcagaatacaatatggaagctgaccaagtacgcggtctactttcagcagatatgcttaaacatgatattgcaatgaaaaaagcggttgacgttatcactagctcagctactgtaaaataattgcttattaaattttgaaaagattgggcttcccagtctttttatttgtgattattcttttgacgaatagctaaaaatagcgtaaaatagtaaatagcgaaaatttgaaaatatgacttatctattttctatctataaagaatattgctaaacaaaatgatagtcttacacaattaaggagaataactttggaattagaagtatttgctgggcaagaaaaaagtgaactttcgatgattgaagttgctcgcgctattttagagcaacgtggtcgtgataacgaaatgtacttcagcgatttggtaaatgatattcaaacctaccttggaaaatctgactcagcaatccgtgagtcattgccatttttctattcagatttgaatacagacggaagttttattccacttggcgaaaacaaatggggacttcgttcatggtatgctatcgatgaaattgacgaggaaatcatcactcttgaagaagatgaagatggcgctccaaaacgtaagaagaaacgtgtcaatgctttcatggatggtgatgaagatgctattgattacaatgatgatgatccagaagatgaagatttcacagaagaaacaccaagtttagaatatgatgaagaaaaccctgacgatgaaaaatcagaggtagaatcgtatgattctgagattaatgaaatcattcctgatgaagatttagatgaggatgtagaaatcaacgaagaagacgatgaagaggaagaagaggaagaagaggtttagacggggattttgtatttgacaaatagtcagatatagtttaaactattattcgggcacctcttatgaggtcagataaagctccctagtgatagggggctattttgtttttgggaaagatacagaatggttccagatagttttctgagtaggcccttgatcagatagtttctactagttttgactagagaagctggtattatttatcaatcatgtgttttgggttttacccgtaaactaactgttagattaacatttaatttaaggagtttttaatgacaaagtatatttttgttacaggtggtgtggtctcttctattggtaaggggattgttgcagcaagtcttgggcgcttactaaaaaaccgtgggctaaaggtgacaattcaaaaatttgatccatatattaatattgatccagggacaatgagcccttatcaacatggagaagtttatgttacagatgatggtgcagaaactgaccttgaccttggacactacgagcgttttattgatattaacttaaacaaatattcaaatgttacaacgggtaagatttatagtgaagttcttaaaaaagaacgccgtggagaataccttggtgcaactgttcaagttatcccacacgttacagatgctttgaaagaaaaaatcaaacgtgctgcgacaactacagattcagatgttattattactgaagttggcggtactgttggagatattgagagccttccgtttttagaagcacttcgtcaaatgaaggcagatgttggttctgataatgttatgtacattcatacaacgttattaccatacctaaaggctgccggcgaaatgaaaacaaaaccgactcaacattctgttaaagagttacgtggcctaggtatccaacctaatatgcttgttatccgtacagagcaaccagcaggtcaaagtattaagaataaattggcacaattttgtgatgttgcaccagaggctgttatagagtcccttgacgttgaccatatttatcaaattccacttaacatgcaagctcaaaatatggatcaaattgtttgtgatcacttgaagcttgagacacctgctgctgatatgacagaatggtcagcaatggttgataaagtaatgaaccttgagaaaaaagttaaaattgcattggttggtaaatatgttgaattacctgatgcctacctttcagttgtggaagcccttaagcactcagggtacgtcaacgatgttgctattgatctaaaatgggtaaatgctgctgaagtgacagaagataatattaaagaacttgtcggagatgcagatggtatcatcgttcctggtggatttggccaaagaggtagtgagggtaaaattgaagcaattcgctatgcacgtgaaaatgatgttccaatgcttggtgtttgtctcggaatgcagctaacttgtgtcgaatttgcgcgtaatgttttaaaccttcatggagctaattcagcagagcttgaccctaaaacaccgttcccaatcattgatatcatgcgtgatcaaatcgatattgaagatatgggtggtacacttcgccttggtctatatccatgtaaattgaaatcaggttcaagagctgcggcagcttataataatcaagaagttgtccaacgtcgtcaccgtcaccgttatgaatttaatacaaaattccgtgagcaatttgaggctgctggatttgtcttctcaggggtatcaccggataatcgtttgatggaagttgttgagttaccagagaaaaaattctttgttgcagcacaataccatccagaattacaatcacgtcctaaccatgctgaagagctttacacagcttttgtaaccgcagcagttgaaaatatgaaataactttatcgcctcccagtattaggaggcgattttatttttttagatagtttcactatcaaagtatcattagctcttttctttttctaaaaataaggtataataggttgcatgaaaaagattcgattatcaaagtttattaaaatgattgttgttattttgtttttaattagtgtagcagctagtttttattttttccacgttgcccaagttcgagatgataaatcctttatttcaaatggtcaacgtaagcctggaaactctttatatgcttatgataaatcctttgataagctattaaagcaaaaaatagaaatgacaaaccaaaatataaagcaagttgcttggtatgttcctgctgttaagaaaactcataagacagctgttgtcgttcatggttttgcgaatagcaaagagaatatgaaggcatatggttggctgtttcataagttaggatacaatgttcttatgcctgacaatattgcacatggtgaaagtcatgggcagttgataggctatggctggaacgaccgcgagaacattatcaaatggacagaaatgatagttgataagaatccatcaagccaaattactttatttggtgtttcaatgggtggagcaacagtcatgatggctagtggtgaaaaattacctagtcaggttgttaatatcattgaagattgcggttattctagtgtttgggatgaattaaaatttcaggctaaagagatgtatggtttaccagccttcccactcttatatgaagtttcaacaatttctaaaatcagagcaggtttttcgtatggacaagcaagtagtgtcgaacaattgaaaaagaataatttaccagccctctttattcatggtgataaggataattttgttccaacaagtatggtttatgacaactataaagctacagcaggtaagaaagagctttatattgtaaaaggggcaaaacatgcgaaatcttttgaaacagagccagaaaaatatgagaaacgtatctctagttttttgaaaaaatatgaaaaataatattgacaacaatatgataagttgatataatttattatgttgttaagcggggatggcggaattggcagacgcgcaagactaaggatcttgtgaccgcttttggtcgtgagggttcaagtccctctctccgcagactagtcgagttcatttggaactcgactttttgcatatttaagataaagatggagtatcacatgtcaaaagtacgtggctttgaattagttagccaatttagcaataaagagttattaccaaaacgagaaacagctcacgcagctggctatgatttaaaagtagctaaaaaaacggttattgaacctggtgaaattacattggtcccgaccggtattaaagcatacatgcaaccaggggaggtcctgtacctttatgatcgttcatcgaatccacgtaaaaaagggattgtcctaataaattcagttggtgttattgatggtgactactataataaccaagtcaatgaaggacatatttttgcacagatgcaaaatattactgatcaggctgttattttagaagaaggggaacggattgttcaggctgtttttgccccattcttattggcagatgacgatcaggctacaggaatgcgtacaggtggttttggtagtactggaaaataaaattattttacgaataatgttagaaaaggctagacttacttcttagccttttttgatgagagtaaacttatattttctctaacttggtgtgatataatgagtgtactagttatttggtaccaagctatcatattaatttagaagttataaaggaggcctgagtggctaagaaaaaatcagtcttcacctgtcaagagtgtggttaccaatcacctaagtatttgggacgttgtccaaattgctcagcctggtcttcatttgtagaagaggttgaagttcaagaagttaaaaatgcacgagttagtttgaacggtgaaaagtcccgaccgacgaagttaaaagatgtttcctcaattaactattctagaactaagactgatatggatgaatttaaccgtgttctaggaggcggtgttgtaccaggaagtttggttctgattggaggagaccctgggataggtaaatctactttattactacaagtatcaactcagctagctaataaaggtacagtattatatgtctcaggtgaggaatctgcagaacagattaagttacgaagtgagcgtctaggcgatatcgataatgaattttacctttatgccgagactaatatgcaaagtattcggtcggagattgagaagattaaaccagattttcttattattgattctatacaaactattatgagtcccgaagtatcaagtgtccaaggctctgttagccaagttcgcgaagtgaccgctgaattgatgcagttagctaaaactaataatattgctacttttattgtaggtcatgtgactaaggagggaacattagcaggccctcgaatgctagaacatatggtggatacggttctttattttgaaggggagcgtcatcacacgttccgtattttacgggcagtcaaaaaccgttttggttcgaccaatgaaataggtatctttgaaatgcagtcgggtggtctagttgaagttttgaatccaagtcaagtttttcttgaagaacgtttagacggtgcaacaggatctgctattgttgttactatggaaggaacaaggcctattttagcagaggttcaagctttagtgactccgactgtttttggaaatgctaagcgtacaacaacaggtcttgactttaatcgtgtcagtcttattatggcagttctagaaaaacgttgtggtttattgcttcaaaatcaagatgcctatttaaaatcagcgggtggtgttaaattggatgaaccagcaattgatttagctgttgctgtagctattgcttccagttacaaagaaaaacccacaaatccacaagaatcatttattggagaaattggactcactggtgagattcgtcgcgtgacacgtattgagcaacgtattaatgaggctagtaaattgggctttactaaaatttacgcaccaaagaattctctagctgggattgaaatacctaaaggcattgatgttattggtgtgacaactgttagtcaggtcttaaaagcagtgttttcaacataatgattagattcggttcagccgaatcttttttggtggcgagaaacatttcgtgaaaaataatgggcaaaatgataatataaaagggttggtatttagtaaatatcgaatgatgttacactaacaaaggagatctctatgaccacttattttgataactttttaaaaaccaatcaagcctatgctgacttacatggaacagctcatctacctatcaagccaaagacaaaggttgctattgtaacctgtatggattctcgtttacacgttgctcaagctctagggctagctttaggagatgctcatattttacgtaatgctggtggacgagttacagacgatgttctacgttctttagttatttcgcaacaacaattaggaacacgagaaatcgttgttctacaccatacagattgtggagcacagacgtttactaacgaagcttttgctgctcaattacagagagatttgggtgttgatatgcatggacatgattttcttccttttaatgatattgaagaaagcgttcgtgaagatgtggcaaaattacatgcttctccattaatcccagatgatgttgttatttctggtgctatttatgatgtagatactggtcgtatggtggaagttaaatagaaaaaatcctgtccttagcgatgggtttttttattttagaaaactagatttaaaggcaacagttaggcttatcatgccttatgctggaattcagacagaggaaacatcttttgctatactgaaactatactataaaagcggaggaaatttaaaatgaaaaaatatgatgtcattgttcttggttttggtaaagcaggtaaaacattagcagcaaaattagcaacacaaggtaaaagcgttgcaatggtcgaagaagacgataaaatgtacgggggaacatgtatcaacattggatgtattccgacaaaaacgcttttagtatcagctagcaaaaatcatgattttcaagaagctatgactactagaaatgaagttacaagtcgtttacgtgctaaaaattttgctatgttggataataaagacactgtggatgtttataatgctaaagcccgctttatatcaaataaagtggtcgaattaacaggaggagctgacaaacaagaacttacagctgatgttattattatcaatactggtgctaagtcagtacaattaccaatcccaggattagctgattctcaacatgtttatgattcaacggcaatccaagaattggctcatcttcctaaacggttaggtatcattggaggcggtaatattgggcttgaatttgcgactttatattccgaattagggagcaaagtgacagttattgatagtcaatcccgtatctttgcgcgtgaggaagaggaattatcagagatggctcaagattatttagaagagatggggatatcttttaaattatcagccgatatcaaatctgtgcaaaatgaagatgaagacgttgttattagctttgaggatgaaaaattaagctttgatgcagtattatatgcaacaggacgtaagccaaatacagaaggtttagcacttgaaaatacagatattaaattgacagaacgtggagctattgctgttgatgaatattgccaaacttctgttgagaatatttttgcagttggtgatgttaatggcggccctcaattcacatatatttctttagatgactcacgtattgtcttaaattatttgaattgtgataaggattattctctaaaaaatcgaggagcagtaccgacttcaacctttacaaatcctcctttagcaacggtaggtctagatgaaaagaccgctaaggaaaaaggatatcaagttaaatctaatagccttcttgtttctgccatgccacgtgcacatgttaataatgaccttagaggtatttttaaagttgtggtagatactgagacaaatcttattttgggagctcgcttatttggtgcagaatcccatgaattaattaatatcatcacaatggcaatggataataaaatcccatatacttatttccaaaaacaaattttcactcacccaacaatggtagagaattttaatgatttgtttaacttttaagaatatttttaaaaagtaaggcaattttgctttactttttttatcgaaaattagtgtggctattattactgattatcatttttagtgatttagtggtataatagagttgattggcaatcatctgtaagagtttgaatgatgttttgcccccttgactaattcagttaaactgaaaaagtttactatcagaaaatataggagtagaattttggctaataagattcgtgtgcgttatgcaccaagtccaacaggattgttacacatcggaaatgcgcgtactgcgctctttaactacctttatgctcgccatcatggtggggattttgttattcgtattgaagatactgaccgaaaacgccacgtcgaagatggtgaacgctctcaattggagaacttacgttggctaggtatggactgggatgaaagtcctgaaacacatgaaaattatcgtcaatcagaacgccttgagctctaccaacgttatattgatcagttgttagcagaaggtaaagcctacaagtcctatgtgactgaggaagaattagcagcagagcgtgaacgccaagaattggcaggcgaaacacctcgctatatcaacgaatttatcggaatgtcagaaactgaaaaagaagcttacattgcagagcgtgaagcagcaggcatcattccgacagtacgccttgctgttaatgaatctgggatttataaatggactgatatggtaaaaggtgacattgagtttgaaggctctaatatcggcggagactgggttattcagaagaaagatggttatccaacttacaatttcgcagtagtcattgatgatcatgacatgcaaatttcgcatgttatccgtggcgatgaccatattgcaaatacgccaaaacaattaatggtttatgaagcactcggttgggaagcgccacaatttggtcacatgacattgattataaactcagagactggtaagaaattatcaaaacgcgacaccaatactcttcaatttatcgaagactatcgtaaaaaaggttatatgtcggaagctgtctttaatttcattgcccttcttggctggaatcctggtggagaagaagaaatcttctcacgcgagcaattaattaatctatttgatgaaaatcgtcttagcaaatcaccagcagcattcgatcagaagaaaatggattggatgagtaatgattacctaaaaaatgctgattttgagagtgtttttgcactttgcaaaccattcttagaagaagctggtcgacttacagacaaagctgaaaaattagttgagctttatcaacctcaattaaaatcagctgatgagattgtaccattaacagaccttttctttgcagattttccagaactaacagaagccgaaaaagaagtaatggcagctgaaacagtcccaacagtcttatctgcttttaaggaaaagttagtatcgctttctgacgaagaattcactagagatactattttccctcaaattaaggctgttcaaaaagaaacaggtattaaaggtaagaacctatttatgcctattcgtattgcggtttctggtgaaatgcatggaccagagttaccagatactatttatttattaggtaaagaaaaatcagttcaacatatcgataatatgttagcaaaattataatataaaaagtcgtgaattttcacgactttttgtgtacttttaccaattgtatttttcaacattgtctttggtaacaaggtaaattggagaaattgtttctttctctacttttttgcctttataataatcaattgctgcttgaattgctatttctcccatcttagctggttgttgtgcaatagtggctgaaatatctccttttttaatggcatcatgggcatctggctgaccatcaattcctacgataagaacattttgcaagccagcagatttgacagcctgtgcagccccaagtgccatttcatcattttgtgcgaaaataatttggacatctttatgtccttgaatcatattttgtgtagtattcaaagctttggcgcggtcaaaattggcagattggcttgaaaggatgtcaagtttagattttgcaactgaatgaaatcctttaccacggtctacagtagcagaggcacctggtactccagataattcaaaggcttttgcttttttgcctagttttttaacggcataatccgcagccatcttaccagcagcaacgttatctgaagcgacagtagttaatactttgcctccctcactaccacggtccattagaataacaggaatattagcgttgtttgcagacttaatagctgttacaatagcttttgagtcaacgggattaatcaaaatagcatctacgttttgactaataaagttttggacatcatctgcttgacgtgcggcgtcatcttgagcatcagctaccttaatgcttatttttttattgctagcatatttgtcaataccgtctttcatcgcaacaaagtagggattgttagttgttgaaatagatacacctagtttcaaatctttagcagattttttggttacattttttgtagaattcccagaagaatttccaagtccagttttaccacatgcacctagaatgaggacaatagacatcaataaggctagaaagccaagtttttttccaaatttcatttgaaactcctttagataaaatataatgaacttatagaaattagagtaaagactattttgctactttaaagcgatcaagtaaaacagccattaaaataacgatacctttcacaacttgttgccaaaatgcagagacaccaatgatgtttaatccattgttcaggacaccaataataagagcaccaatcaatgttccaatgatacgtcctttcccaccagataaagacgttccacctaagacaacggcggcaatagcatccatctcataacttgctccagctgttggttgtgctgagctaaggcgtgatgtgataattaacccagaaatggaagccatgatacctgagatagtgtagatgataattttaactttgtttaacttaatacccgagatatacgctgctttttcattacctcctaaagcgtaaacagatttcccgaaggctgttttatgtaacaaaatatacaaaataataaaagtaagaaacatgagaatgactgggaatgggataccaacaatatagccttgtcccaaaaattggaatagaaaactatcggataagccagcggtaattgggttgccgtttgaataaactagcgttgctcctctaaagatagtcattgttgccagtgtaacgataaatggtgctaattttccgtaagaaatgaagagtccgtttagcattcccaagatgccacctaaggcaacagataaaacgatagcaataccaacgggtactccgtggccgattaatccagctgttaatgcactagatagggctaatatggacccgactgataaatcaataccgccagtcaaaataacgaaggtcatcccgaaagcgataaaaccatttgcagttacttgtaataataaattgagtagattattggttgtgaggaaattaggattaatgagtgtgataataaccattaaaccagctaacgcaatcagggttgttaactctgatatatatttcatcatatttttcactttacttacctcctgtggctagttgcataactttttcttggtcagcttcttttcgactgagttctccactgattcgaccttcgtgcattaccatgatgcggtcactaacacctagaatttcaggtaagtctgatgataccatgacaattggaacacctctgtctgctagttcattcattaattggtaaatctctcgtttagcaccgacatcaacaccacgcgttggctcatcaagaattaagactttaggagcaataccaatccatttagcgagaacgaccttttgttggttacctccagaaagatttccaacctctaaatctggtctccctgatttaatgtagagacgattaatcaattgttgcacaaatgttgtgcttgttttttcatcaaagaaaccatgtttgctaaaatctttagtgctagggagagtcatattgtccttgatattgaagtctaggatgagaccttcatcttttctattttcggtcaaaaaaccaatgccctgcttgatagcttggcttggggtagtaatagtgatttcttggtcatcaattttcaccttaccagacttctttttatcaattccaaagatagttcgcataacttcagtacgcccagctcccattaatccagaaaatccaagaatctcgcctttacggacataaaaggaaacgtcctcgaaattatctccacagaggttactaacttcaaaagcaacaggcccaatttcagaatgtttttcaggatagtaatcttccaattttcggccaaccatttttttaaccaattcgtcagaatttgtgagtgatgtttcttttgtatctacaatgacaccatctctcatgacggttacgaagtcagtgattttaaaaatttcctccattcgatgggagatatagacaacgcccactccttcttgtttcaaacctcggataactcggaaaagattttcagtttcacgatctgttaaagcagcagtcggttcatccattaccaaaatagagagttggtttaggagacttttggcgatttcaatcatttgttgttgtccaacagacaagttaccaatcgggatgtctaggggaatagtcacacctaatcttttaaaagtttcaagtgctttttgtctcattaatttttgattgagtaagccaaaagttgtcttgatttcacgtccaagaaagagattttccaagacagtcatttccggccaagtattcatctcttggtgaataaaactaataccaaattcctctgcttcttgagggtttgaaaaagttcgttcctcgccatcaatataaatagttcctgtacttgctggaaaaagtcctgttagaatgttcattaaggttgatttacccgcaccattttcacccataagcgcgtgtatttgaccagattgtaattccaaatcaatcttttctagaactttattagtaccgaaggatttggagatattcctcatgtcaattttcatggactaaactcctttctagatgataacaccagattgtagaataatatttgaatacggtgtattttcacctgtacgaataactgctttgacatcttgggtcatttgttttaaatgattgtgactgacgtactctatgctaacagagttatcaagtttagctaataaccttgataattgatccggatttgcttccttgatttcttctgctaaaatgactttttcaactaagatattctctaaatagatatcaagtacctcttggaaactaggtattccagaggtcaaagacaaatcaatctttggaatgccatttggaacaggtagacccagatctccaatacaaactcgatcagtatgcccaaggtcgtctgctaatttagcgagatgactatttaatataccagtctttttcataatgttggttgtcctccatttctttaattgtaggcatgccaccctgtgcaccaaatttttgcacggataagtgagcagctagagttgcaaaacgtaaggccttagcaatcttaaattttttcgagatagcataaccgaatgcaccgttaaaagtatcacctgcaccagttgtatcaacagctttagtttctaaagcaggaattaaatgactttcttttccatcagagtagatggctccttttgtgccgagtgttacgattagtttttcaggatatgtggctaatatatcctctagtttttggtttgggaacagctcttgacattcgtgttcatttggtgtgaaataatcgaccttatcgagcatctcaatatcagtctctctagatggtgcaggattatagagtaatttaatactatgttctttacaaaaattagcaattttcatatttgcttgatgaggaatttcattttgtaatacaactaaatcagcttctttaattattgaccactcctgagaccattttttagtatcaacttttccgttggctccaggacagtaaatgattcgattatcattattataaagagtgatttgggcaacacctgaagaagatggtatcgttcccacaaaatccgtagtaacatgatttttgtttaaattatccaaaagaatgggaccaaaagaatcctcgccaatggcaccaagaatagtaatattatctcgctcttggctaagacgcccaatagcgacagcctgattagcacctttacctcctggaaccattgaaaaacgttggccaaatacggtttctccctctttggcgatacgattggtttccataactaagtccatggaaatactaccgataatgacaatgttactcatctattttcctccttagggtttcacgttcgacataatgaacgggtaatttaatacgcttattggtaataggtaattgattagtaattttgaaaattaattcagctgctttttgtcccataatatatgatgattggtgaatagttgacaacgaagggtagataaattggctcattaaaatatcatcataaccaataatttgtacatcttcagggattcgcttccctcgattaagaatctcgtgtaggtaggcaatagcatgtatatcagatggagcgataatgctatcaatgtctggatggtggtcaagtaaagttttcgcttcaatttgaatctctgcaaaatcaaaactggcactatcttcgatagcaaaacaagcccctttgtttaataggtaattttggcttccttgaaacctttgattaaggttatcagctttatctagcggaccacgaatgagtaatatattggtagcacctgctgtccaaatagcttgagctgctaattttcctccctctttattatcagagaaaacgccgtactgtgtttcttgattaacgcggtcaacaactacaactggaatatctatttcaggatgatttttggtgaaatcgtgtgttgtaataatccctgcagcattactttgtaatagcacatttaagtactcttcttctaaatggctcttgttatttgtgttgccaagcatgacacgataaccctgttcttttagaaattcttcaactcctctagcaagtcttggaaagaaagggtttgaaatatcgggaagtagtaatccaacaagttgattttttttggttttcagagattgtgcaaggaaatttggaacataatggagttcgcggatagcttgctcgattttttgacttgctttttgactaacgtaaccattttgggatatataccttgagacagtagatgttgatacgccagctttctcggcgacttgtctaatcgtactcatagaaactcctttcttatattgtggaaacggtttcacaattagaattgtaatcgcttactaaaaaattgtcaagctattttttaaataatttaatgataaaatatcattatttttagaggtcatattcaagtcataaagctgtgatactatgttcacatcaaaagatcaaaggagaaaaaccatgtcacatgcttggaaagaattaaccttttataagaaaaaatacctcctgattgaattgctaatcattgttatgatgttcatggtagtttttttatcaggtttagcaaacggtttaggtagagctgttagtgctgctattgaaaataacccagctcaaacctatattttgaatgaaggtgctgaacaagtgattacatcatctgtattgacaactaaagatcagacagatttaaacagtttgaatttaaaagatagtaccactttaaatattcaacgttcgagtttaactcgacaaggacacgaaaagaaaattgatatttcttattttgctattgataaagattcttttatggcacctacactttctgagggaaaacaactgacaagttacaaaaaagctattattttaaatgatagtttaaaagctgaagggataaagttaggtgataaagtgattgataagtcatcatctatatcactaacagtcgttggatttgtccataatagtatgtatggtcacggacctgtggcatttattgataaagacatttataccgaaattaataaaaagattaatcctcaataccagttcttacctcaggcattagttatgaaaaatgataaaagtatatctcatttaccaactcaattagaagctgttagtaaaaaagatgtcattcaacatattcctggttatagtgccgaacaatccactttgaatatgattttatgggtccttgtcgtagcttcagctggtattttaggtgtctttttctacatcatcacacttcaaaaacgtcatgaatttagcgtcatgaaagctattgggacaaaaatgtcagagattgccctatttcaattgagtcaagtcattatattggcactgtttggtatcattgttggagatggattggcggttgctctctcttatgtattaccagctcaaatgccatttgttattaattggcaaaatattattctagtatcgtttgtatttttagtcattgcaatgattagtagtgctttgtcaattgtaaaagttgctaaaatcgacccagtcgaagttattaatgggggaggagaataatgtcagcaatcttagaattaaaacacatctcaaagcactatccagatggagatgagcttttatcaatattagataatttagatttatcagtttctgcaggtgagtttgtagctatactgggaccctcaggttcaggtaaaagcacacttttatccattgcagggttacttcttggcgcagatcaaggtagtttgtatgtcaatcatgagaacgttacggatttgtctcaaagacaaagaacacaattgcgccgtgaagcactaggttttatatttcaaagtcatcaactgcttccttatttaacaatccaagaacagttgcaacaagaggctcgatttgcaaaacactatgataagaaaacaagcttggaagaaattaataaattattatcagatttaggaatagagcagtgtgcacataaataccctaaccaattatcgggaggacaaaagcaacgcgcagcaattgctagagcatttattaatcatcctaaggttatcttggcagatgagccaacagctagccttgatgaagaacgtgggcgtcaagttacagaacttattcgtcaggaagttaaatcacataatactgcagctattatggtgacacacgatgagcgcgttctagatttagtagataccgtttatcgtttaaaggacgggaaattagttaaagaaaacttctaacttgtgttacaataagctagaggtgatttaatgattaaaatattagttgtagaggataacattgttcaacaaaaaatcattaccacaaaattaacacaagagggctaccaatttatcactgcttcaaatggacaagaagctctaaattgtctagatacagaagaagtacaattgattataactgatatcatgatgcccatgatggatggttatcaattaattcaagaactcaggtcagctgcttataatgttccaatcattgttatgacagcaaaatcacaaatggaagatatgacaaaagggtttggccttggtgcagatgattatatggttaagcctgtgcagttacaagaattagctttacgtattaaggcactcttgaggagagctaatattgtagctcaacatcagctaattattgggaatacttgtcttaatgaagatgaattaagcttgaaatattttgagcaagaaattatatttcctcagaaagaatttagggttcttttccacttacttagctatcctaataggattttcacacgtttagaactattggatagtatttggggaatggatactgatttagatgagcgggtggtagatgcttgcatcaataaaattagacgaaaagtagaacacttaccagattttaagattgagacggtgagaggggtagggtatcgtgcaaaaaatgactaagctaaggcgatttcggtttccgttaagattttatttcacattaatgtttgtgttaacgatgcttttctcagtcctagcttctcttttactagttgcagcaatagtttttactttttttcaaggagtcttaactactcatgtattacaagttagtgctctcgctgttgtttttttaagccttgtgatagctagtattagtatgtggtacggttcttatcatttaacaaaaccaattttagatattagccatattgtgtccaatgttgcagacggtgactttgaagggcatatttatcgaaacagtaatcgtcgtaaatcctatgagtattataatgaattggatgagctatctgaaagtattaatcagatgattgtttctttatctcatatggatcatatgcgaaaagactttatcactaatgtttctcatgagctaaagactccgattgctgcagtagctaatattgtagaactattacaagatccagaattagatgaagaaacacaaagtgagttattaggtcttgttaaaacagagagcctaaggttaacaagattatgtgatacgatgttgcaaatgtcgcgcgtggataatcaggagactattggggagctatcctctgttcgtgtagatgaacaaattcgtcaagcaatgattagtttaacagaacgttggcaagctaaaaggataaattttcaactggattcaaaaccatatactgtttactcaaactctgacttgctgatgcaagtttggataaaccttttagataatgcaataaaatattccgaggatattgtagacttaagtgtacgaatggaagaaactaataatcattatctgagagttattatttctgataaaggtaggggaatttctcaatatgatgttcagcatatatttgataaattttaccaagcggatcagtcgcataatcaacaaggaaatggattaggactagcaatagttaaacgtataattgttctttgtaagggacgtattagtgtctccagtcagttggaaattggaacagaattttgtgtagaactacctttatcataattatttaaaacaataactgccaattggcagttattgttttatttgtttagaaataaatatactaaaaatagacaaaaactataaaaatatttgacaataaatatagcaagtgtataatattacaaaacataggaatttggaaggggattttttatgggaaaagaaaaattaattttagcttattctggtggtttagatacctctgttgctatagcttggttaaaaaaagattatgacgttattgctgtctgtatggatgttggcgaaggtaaagatcttgattttattcacgataaggctttaacaataggtgccatagaatcttatattttagatgttaaagatgagttcgctgagcattttgttttaccagctttacaggcacatgcgatgtatgaacaaaaatacccgcttgtttcagcgcttagtcgtccaattattgcccaaaaattagttgaaatggcacatcaaacaggtgcgaccacaattgcacatggctgtacaggtaaaggaaatgaccaagtgcgttttgaagttgcaattgcagcactagatcctgaattaaaagtaattgcccctgttcgtgagtggaagtggcatcgtgaagaggaaattacttttgcaaaagctaacggcgtacctattccagcagatttagataacccttattctatagaccaaaatttatggggacgtgccaatgaatgtggtgtgcttgagaatccttggaatcaagcgccagaagaagcttttggtattacaaaatcaccagaagaagctcctgattgtgcagaatatattgatattacgttccaaaatgggaagcctatagctataaacaatcaagaaatgacactagcagatttgattttatcgctaaatgaaattgcaggaaaacatggtattggacgcattgatcatgttgaaaatcgtttagtcggtatcaaatcacgtgaaatttatgaatgtcctgcggcaatggtactgttagctgctcataaagaaattgaagatttaacactagttcgtgaagtgtctcattttaaacctatccttgaaaatgaactatcaaatcttatttataatgctttatggtttagtccagctacaaaagctatcattgcctatgtcaaagaaacacaaaaagtggttaatggtactacaaaagttaagttatataaaggttctgcccaagtcgttgctcgccactcatctaattcattatatgatgagaatttagcaacctatacagctgctgatagctttgatcaagatgcagcagttggttttatcaaactctggggacttccaacccaagttaatgcccaagtaaacaaaggataaataaaggaagataagaggatgacaaaaaatcataagttatggggtggtcgttttgaaagtagtcttgaaaaatgggttgaagagttcggtgcatcaatcagtttcgaccaaaaattagctccctatgatatgaaggcttctatggcccatgtcacaatgttaggcaaaacggatattattagtcaagaagaagcaggcttgataaaagatggtttaaaaatactgcaagataaatacagagcaggtcaattgacttttagcatatcaaatgaagacattcatatgaacatagagagcttattaaccgctgaaattggagaagtagcaggtaagcttcatactgcacgttcacgaaatgatcaagtggctacagatatgcacctttatttgaaagataaattgcaagaaatgatgaagaaattgcttcatttacgaacaaccttagttaatttagcagaaaatcatatctatactgttatgccagggtatacacatttacaacatgctcagccgatttcatttggacatcatctaatggcttactataatatgtttacgcgtgatacagagcgattagagtttaatatgaaacacaccaatctatcaccattaggagctgctgctctagcagggacaacgtttcctattgaccgccatatgacaactcgtttattagattttgaaaaaccatatagtaattcgcttgatgctgtctcagatcgtgactttatcatagaatttttatccaatgctagcattttaatgatgcatttatcacgtttttgtgaagaaatcattaattggtgcagttatgaatatcaattcatcacattatcagatactttctctacaggatcatctattatgcctcaaaagaaaaatcctgatatggcagaattaattcgagggaagacaggccgtgtttatggaaatttatttagtttactaactgttatgaaatcattgccgttagcttataacaaagatttacaagaagataaagaagggatgtttgatagcgtagaaacagtcagcatagctattgaaatcatggctaatatgcttgagacaatgactgtgaatgagcacataatgatgacctcaacggagactgatttttcaaatgcaacagaattagcagattatttagcaagtaagggggtacctttcagaaaagcacatgaaattgtaggtaaattggttttagaatgcagtaaaaatggttcttatttacaggatatacctttaaaatattatcaagaaatttcagagttgatagaaaacgatatctatgagatattaactgcaaagacagcagttaaacgaagaaattcattaggaggaacggggtttgaccaggttaaaaaacagatcctattggcacgtaaagaattgaaagcggaatgactgctttctgaaaaaaccctcgtttaactctgttaagtttctcacgtattttcagtaaaaaactagcattttttatagaattgtgctagaattaacgtgtaagtgggcaacgcccaaaaaataaataggaggcctgaataatggcaatcgtttcagcagaaaaattcgtccaagcagctcgtgataacggctatgcagtaggtggatttaacacaaacaaccttgagtggactcaagctatcttgcgcgcagcagaagctaaaaaagctccagtacttatccaaacttcaatgggtgcggctaaatacatgggtggttacaaactttgtaaacaacttattgaaactttggttgaatcaatgggtattactgtaccagttgctatccaccttgaccacggtcattacgatgatgcccttgagtgtattgaagtaggttacacttcaattatgtttgatggttcacaccttccagttgaagaaaaccttgaaaaagcacgcgaagttgttgctaaagcacatgctaaaggtatttcagtagaagctgaagttggtactatcggtggtgaagaagatggtattgtcggtaaaggtgaattagcaccaatcgaagacgctaaagctatggttgaaactggtattgacttcttggctgcaggtatcggtaacattcatggaccatacccagcaaactgggaaggacttgaccttgatcacttgaagaaattgactgaagctgttcctggtttcccaatcgtgttacacggtggttcaggtattcctgatgatcaaatccaagaagctatcaaacttggtgttgctaaagttaacgttaacacagaatgtcaattagctttctgtcaagcaactcgtgactacgctgttgaattcaacgctaacgaagctgaatacatgaagaaaaaactctttgacccacgtaaattcttgaaacctggtttcgatgcaattacagaagcagttgaagaacgtattgacgtgtttggttcagcaaacaaagcataattaacataaacagataatagttaaaagctcacttatggtgagctttttttggattatatgactttttattaaatagatactctttaaagattgatatgcttaagataatttcgaataaatgccgctgaatctgtgagttgttgctcttcttttgggcttagtgaaagagaaattctttctacaattcctactctaccaataatagctggatatccaaggtaaaccccttcggactcatagaaggtagatacaggtagtaactcatgggaatcatttaacacagttaaaacgatgcggacagctgcggtagcgataccataactagtatattttttaccaaaaaagacagtgtgcccgccttttaaagaagcttcttttatctgttctaattcttctgcttttaatagtgatatagctggttgtccttttacagttacctgactccaagcgacaaattgggagttaccatgctctcctagattataaccaccgatactccttggatcaacttgtaggcgttgaccaagcactcttttcatccgagcagtatccaataaggttcctgttccgataacgcgtgatttaggaaattgagtatattcttgataaagctgggtaatggcatcaacaggattagtaacgacaataaggatccctctaaaaccagatgattttaacttttggctaacgtcgtagacttctttactggtaaatggtagttcagcaaagcgattagcttctttgttattctgtagtgaaatatcacctaaggctgaaatcacaacatcagcatctgacaacgcgtcatagtcgtttaatactagattagcgtgataagtagcatttgccagagcatcttgaaaatcaatcatatcagcattaaccttatcaacattagtatcaataaagacataatcatcaccaataccttgtgcaataagagcgtgtgcaacagttgatccaacgtgccccatgcctataattccaattttacgtgtcatatgaaacctcctttgattattgttgtctattataatattttgaaagaaaatgtaaactaaaaaatgaattagaaggaagtgtgtcttattataaaaaatatgtaagcgatttagataaaacaaatgaaaaagtaattttgaaaagaacttgctagaagaagtaagttgtgatagaatagtctagtatgtggtgctagcacatccgtaaatattgatcaatataggaggaactcgtaaaatggctaaagtatgttatttcacaggacgtaaaacagtttctggtaacaaccgttcacacgcgatgaaccaaacaaaacgtactgttaaaccaaaccttcaaaaagttactgttcttatcgacggtaaaccaaaaaaagtttgggtttcagctcgtgcgcttaaatctggtaaagtagaacgcgtttaataaactgagaaagccttagggctttttttagtgtttctaaggctgatttgatagttagatgcctctatttttttacaataatagtgagatatgatagaatagagtgataaaaactttttgaggtagtagatatgactgtaaaaatcaatacaagagatggtcaaattgaactctctgatgacgttattgcaactgtcgttggaggttcagcaacggaaatttttggcgttgttggtatggcaagtaaaagtgctatcaaagataactttcaagcacttttgcgtaaggaaaactacgcaaaaggtgttgttgtgaggtctagtgaagcgggcatcgtagtagatgtttatactgtcatgagttacggcgtcaaaattagtgaagtttcaaaaaatattcaagagcgagtgaaattcaatctcgaaaatcagcttggtttatctgctgatatggtgaatgtttatgtgcaaagtattaaggttgtaggagaagattagtgtcaaagattacgacaagtttattccaagaaatggtacaagctgccagtacacgtctgagtaaacaggcagagtatgtcaactcattaaatgtattcccagttccagatggtgatactggtacgaatatggggatgactatggaaaacggagccaaggaagtttcggacaaaccagcgacgactgttggagaagttggtcaaattctttctaaaggtgtattgatgggagcacgtggaaattcaggtgtaattacatcacaattattccgtggttttggtcaaagtatcaaggataaagaagaattaacgggtcaagatttggcacacgctttccagaatggtgttgaagtagcttataaagccgttatgaaaccagttgaaggaactatcttgacagtatcacgcggtgcagctaccgctgctctaaaaaaagctgaagaaactgatgatgcagttgaagttatgcgcgcaactctcaaaggtgctaagcgtgctcttgctaaaacaccggatatgctacctgttcttaaagaggttggtgttgttgattctggtggtcaaggactcgtctttatttacgaaggtttcctctcagcactgactggggaatatatcgcatcagaagattttaaagcaactcccgcaacaatgactgaaatggttaatgcagagcaccataaagctgtagtaggccacgtagccacagaagatattaaatatggctattgtacagaagtcatggttggtttaaagcaaggaccaacttacgttaaggaatttaactacgaagaatttcaaggttatcttagcaatctaggggattctttactagttgttaatgatgatgaaattgtcaaggttcatgttcatacagaagatccaggtcttgttatgcaagaaggtttgaaatatggatcgcttgtgaaggttaaagttgaaaacatgcgtaaccaacatgatgcccaaatgcaaaaggttgaagttgaagaaactgtcaaagaaactaaagaatatggtattattgctgttgtagctggtgacggtctagctgagatttttaaatcacaaggtgttgattatatcatctctggcggccagactatgaacccatctacagaagatattgtaaaagcgattgaaaaagtaaacgctagaaatgttattattttaccaaacaataagaacatcttcatggctgcacagtcagctgcagatgtcgttgatattccagcagcagtagtagagacacgtacagttccacaaggatttactagcttacttgcttttgatcctgctaagtctcttgaaactaatgtagctgatatgacaaatagcctctcagatgtcattagtggtagtgtgactttagctgttcgtgatacaacgatagatggccttgaaattcatgaaaacgacatccttgggatggttgatggtaaaattctagtatctacaccagatatggaaaaagcacttaaagacacttttgataaaatgattgatgaagatagtgaaatcgtgacaatctatgttggtgaagatggtaagcaagcattagctgagaccttgtcggaatatcttgaggaaacttatgaagatgttgaagttgagatccaccaaggagatcaacctgtatatccatacctcatgagcgttgaataattgataaaataaaaaattaggagagatacttctaattttttattttatcagagtttctattttagtatgataaagcatcagtattttgaaaattttgacaaattgtgttagaattgttttaaaacattcatacaaaggagatttatgatgtcattaattattcttacggttattttggttttagtgattgttctgttgataacttctttatacgttgttaaacaacagacagtagccatcattgaacgctttggtaaatatcaaaagactgctactagcggtattcatattcgtgtaccattgggtatcgataagattgcagcacgagtgcagttacgtcttttacagagtgaaattatcgttgagacaaaaacaaaagataatgtttttgtcactttaaatattgctacacaatatcgtgtcaatgaaaataacgttacagacgcttattacaaattaataaagccagaagctcagattaaatcttatatcgaagatgctttgcgttcatcagtacctaaacttacattagacgagctatttgaaaagaaagatgaaatagccttggaagttcaacatcaagtggcagaagaaatgtcaacatacggctacatcattgttaagactttaattactaaggttgagccagatgcagaagtaaaacaatccatgaacgaaatcaatgctgcacaacgtaaacgtgtagcagctcaagaattagcgaatgctgataagatcaaaattgtaactgctgcagaagcagaagcagaaaaagatcgtctacatggtgtgggtattgcgcaacaacgtaaagcaattgtagatgggttagctgattcgattcaagaattgaaagatgctaacgtgacattgacagaagaacaaatcatgtctatcttgttaacaaatcaatatttagatactttaaatacatttgctattaatggtaatcaaacgattttcttaccaaataacccagaaggtgttgaagatattcgtacacaagttttatctgctcttaaaacaagataatgaactttttatagaagcaaaataaccagagcatttgctctggttattttgtgtctgacttatttattataattggagagacggaaaaaagttattttttaccgtaacgtttgtactcatgaatgattttcagagcacgttttctagttttaatgttaggacttttaagtctgcgataggctgacgataggtctgttttttcagccatgattacctcctatagacaatttattaacgttaacagacaccagtataccacaaaaaaattaactggtaaagtactttgttgataaatttaaaaataaatagcaaagtaattaaatatcaatcaaaagtaataagttcaaagatatattaaacctttattaatgaggtttggatttgacaagtgatgttaagtgaaagatgaatgaggaaaatacccaacgagaaagtagctaatggctatcattgtgcatataaaaaaacgatcgatgagtgatcgtttttcagcaaactaaataattatttttaatgtaattgaatgaaaatttatacttgtgaaagtgtatcggttaagttaataaggtcagtttttatttatcgtaagcacttaggaagtgttttggagcatacccacgagagtagataaatccggcatcgcgtgaaggatagcttgattcagaaggcgcatacccacgagagtagataaacccggcatcgcgtgaaggatagcttgattcagaaggcgcatacccacgagagtagacaaatccggcatcacgtgaaggataagacactgtgtctgccttcgcaagacttgctaaagtagctaataatagagtgacagctgaagctgctgttaaaacactgattttaagtttcattataaaatcctttcaaagataataaactattcttgcacagtggttagttcattttgtgcatactatattatatcatcaaaagctcattcgaacaacatgtttttaattttaaacaaatatatgattaatcaaatatcgcttaaaattaaaaaatgagatttagtaacttatttaatagtatacaatccaataacgactgtctaatttaatctatagttgaagctagtcgtggatttcactaaagatgtagcaataaaaaatcccctccagttccattgcaatgatgacaatgacaaaacctgtaggggtataaatagtctatatttaaatgtgaataaattttattttaagaagcgttgtagaaattccttagttctttcttgtgttggattttcgaaaagttgtttaggagtaccctgctctgcaatgattcctttgtccatgaaaataacgcggtctgatacttctttagcaaattccatctcgtgtgtcacaattatcattgttaatccagatttagctagatcttgcattgttttaaggacctcaccaaccatttctggatccaaggctgaagttggttcatcaaaaagtatagcttctgggttaacagaaagtgctcgggcgattgcgacacgttgcttttgcccacctgataattgttttggtttagctttccaatattgctcagtcatgccaacagcatttaagttttctttagcaatcttttcagcttcttggcgttcacgttttagaacagtagtctgtgcgacaatagcattctctaagatatttaaattttcaaagaggttaaaagattgaaagaccatcccaagtttttcacgataattatttaaatcatagcctttttcaagaacattgtgaccgtgatataagatttctcctccacttggttcttctaagaggttaatagaacgtaggaaagttgattttcctgatccagaagaaccaatgatagaaataacttcgcctttgttgaccgaaagcgaaatatcttttaacacttcattgcttccgtaagattttttcaaatgtttaatttctaaaatagcttgtgtcataccaacctcctagacttgtaattgattcgcaccggttgtgtaattatctgaatcaaaacgtttttcaatgtaacgtaagatacgtgttacggtgaaggttaagatgaagtaaataatcgcaataatggtgaatgtttggaaatattggtaggtttgtgttgcaacagtattaccagagaagtagagttcgacaacagagataacgttcagtacagaggtatctttgatattgataacaaactcattaccagtagctgggagtatgttacgtacaacttgtggtagaacaatttttcgcatggtttgtccgtgggtgaaaccaagtgcagttgcggcttcaaattgtcctttatcaacagagaaaataccaccacgtacaatttcgctcatataagcaccagtattgattgaaacaataaatatagctgctagtgtacggtccagcgaaactccaaaagcttgtgctgttccgtagtagataaccatcgattgtacaatcataggtgtcccgcggaagacctcaatatagatgttaagtaaccaacctaataatttttgtaaggcagcctttaacttattgtcagattttggtgctgtacggaaaacaccgatgagaaggccgataaataatccgacgattgttcctaccatagaaattaggagggttgtagctgttcctctgaggaattgagaaccattgttttttaaaatagttgccatctgttcaaagaagtttggtttcccatttttttcttttttaacggatggctgttctttaatcatcttatccatcaaggcgatttgtttatctctagaaatgctttcgagaacttgattaacttgattaatacgattgtcacctttacgcatcccaacagaaatatttgtatcggcatcagatgttttaaacccttggtgcagttcaatcatttttaatttaggattagcagtttgagcggaagttgcatctggacgttctgaaacataggcgtctacaacaccagattctacagcttgtcttaattgattgaagtcccccatggcaacttcttttttgacaccattgatttgatcaatgaggttgtataagtagactccttgttgggcagttactttagcatttttgaaatcactaatatttttagcattagtatattttccttcagcattaacaactagagtaggttctgaaatgtagtaaggctttgaaaaattaatttcttttttacgttcttcggtaggactcattcctgcaataatcatatcgagttttccagaagttagtgctggaacaaggccttcccattttgttttgacaacaacaacttttttatttaactttttagctaactttttagcgacttgtacatcataaccattagcatattgatcagttccttcaataggaactgcaccatttgtgttatcattttgtgtccagttgaaaggagcataggctgcctccataccgacacgtagatattcatctgcttgtatacttgtcatacctccaaaggtgataagcaaagcagtgaataaacttagtaatatttttttcattcaacagcctccgataagttacttcctcctattttaccgaaaaacaaggtcgatttcaatatcattatcttattgaaagcgattaattgtatttttatgttaaaatggtatacaaacaaaggaaggaggatgataatgaagaaatgttttttggctatttgtttagctcttagtttttttatggtttcagttcaagcagatgaggtggactataacattcctcattatgagggtaatctaactattcacaatgataatagtgctgattttacagagaaggttacttaccaatttgattcgtcctataatggacagtatgtcacattaggtacggcgggtaagttacctgacaattttgatattaataataagccacaggttgaagtttcaattaatggtaaagtaaggaaagttagttaccagatagaagatttggaggatggctaccgtttgaaagtgtttaatggtggtgaagcaggtgatactgttaaagtcaatgttcagtggaaactaaaaaatgttctatttatgcataaggatgttggtgaacttaactggattcctattagcgactgggataaaacgttagagaaagtagatttttggatatcaactgacaaaaaggttgctctttctcgtctttgggggcacttgggttatcttaaaactcctcctaaaataagacaaaataataatcgttaccatttgacagcttttaatgtaaacaaacgattagaatttcatggttattgggatagatcttattttaatctacctacaaacagtaaaaataattacaagaaaaaaattgaatatcaagagaagatgatagagcgtcatggttttatcctaagtttcttgttaaggatattattaccttcattctttattattgtgacactattcatctcaattagggtgttcctgtttagaaaaaaagttaataaatacgggcaattccctaaggaacatcatttatatgaagcacctgaggacctttcaccactagagttaactcaaagcatttatagtatgagttttaaaaattttcaagatgaggagaagaaaactcaccttatcagtcaagaacaactcattcagtcaattctattagacttgattgatagaaaagtattgaattatgatgataacttgttatctctagctaacttagatagagcttctgatgcagaaatagattttatagagtttgcttttgcggattctacgagtttgaagccagatcaactcttttctaattaccaatttagttataaagaaacactacgtgaactgaaaaagcagcacaaggcttcagatctgcaaactcaaatgagacgccgaggaagtaatgccttatcaagaattacgcgtctcacaaggttgatttctaaagacaatataaactctcttagaagaaagggaatttcatccccttatcgtaaaatgtcttcagaagagtctaaagaattatctaggttgaaaagattcagttacctatcacctcttatttcttttgttgttataatttatacgctttttttaaattattttacctatttctgtatctatctcttattgtttggtgttatcctgttgttgaataaaatcatttttatgatgacaagaaaaataagtaacggttatattgtaactgaagatggagcaagtcgtgtctaccaatggactagttttaggaacatgctaagggatatcaaatcgtttgatcgttcagagttagaaagtatcgtattatggaatcgaatattggtttacgctactttattcggctacgctgaccgtgttgagaaagcactcagagtgaaccaaatagatattccagaaagatttgcaaacattgatagtcatcaatttgcgatttcagtcaatcaatctagtaatcatttttcaacgataactgaagatgttagtcacgcttctaattttagtgttaattcaggcggttcttcaggtggtttctcaggcggcggaggcggcggaggtggtggtgccttctaattttccaaaagtatggtataataaagaaaaatttatggagttattatgttaataattgaattactcaaagccctatttttaggagtcgttgagggagtgacagaatggttacctgtttctagtactggccatttaatcttggttcaagagtttatgaagttgaaccaaagcaaatcctttgttgaaatgtttaatattgttatacaacttggggcaattatggcagttattgtcatttattttaaacgccttaacccatttcagccaggtaaatctgctagagaaattcgtttaacttggcaattatggttaaaagtagtgatagcttgtattccatctattttaattgctttaccatttgataattggtttgaagctcattttaatttcatgatcccgattgcaatagccctaatcttttatggttttgtcttcatatgggttgaaaaacgtaatgcacacctcaaaccacaggtaaccgaattggcaagtatgtcttacaagacagctttcttgattggatgcttccaggttctcagtattgttccgggaaccagtcgttctggagctactattttaggagcaattattattggaactagtcgttcggtcgctgctgactttactttcttccttgccatcccaactatgtttggttatagtggacttaaggcggttaaatactttttagatggtaacgtcttgagtttagaccaatctttaatacttttagtagcaagtctgacagctttcgtagttagtttatatgttattcgtttcttgacagactatgtcaaacgacacgatttcaccatctttggtaagtatcgtatagtcttaggaagtttactcatcctctactggttagttgttcatttattctaaaatataacataaaaagctgagtattcctcagctttttagcgtgttaggctgtgaaaaattgctaaaaaatagctttttcggtataataagaaaactgaatactcgtatgaggtgatgatatggaaatgaaacaaatcagtgaaacaacactgaaaattacaattagtatggaagatttagaagatcgtggtatggagctgaaagatttcctaatccctcaggagaagactgaggaatttttctattctgtcatggatgaattagacttgccagaaaactttaaaaatagtggtatgttaagttttcgagtaacacctaaaaaagatcgcattgatgtttttgttacaaagtctgaattaagtaaagatttaaatttagaagaattagcagatttgggtgacatttcaaaaatgtctccagaagacttttttaaaacattggaacaatcgatgttggaaaaaggggatacggatgcccatgccaaattagcagaaattgaaaatatgatggataaagcaactcaagaagtagttgaggaaaatgtttctgaagaacaacctgaaaaggaagtagaaacgattggatatgttcactatgtctttgattttgataatattgaagctgtagttcgattttcacaaacgattgattttccaatagaagcttctgaactctataaaaatggtaaaggctatcatatgacaattttgctagacttggaaaaccaaccaagctactttgctaatttgatgtatgctcgaatgcttgaacatgctaatgtgggcacaaaaacacgagcttacttgaaagagcatagtattcaattgattcatgatgatgctatttcaaaattacaaatgattgagatgggataaaatgataccttttacaattgagtatatttttgtattgattggagcatttttattatcaatcattctaactcctattattcgagttatatctttgaaggtaggagcggttgataaaccgaacgctcgaagaatcaacaaagtaccaatgccaagtagtggtggtttagcaatatttctctcctttgttgtaacaacattatttttcatgccaatggcggccagtagacactttatagaagtctcttattttcactacattttgcctgtaattattggcggtctcgtagttacaacaacaggattcatagatgacatctttgaattaagacctcgttataaaatgttgggaattattattgcagctattatcatatggaaatttacacattttagatttgatagttttaagattccaataggtggtccactcttggagtttggtcctattttaactttctttttgacagttttatggattatttcaatcactaatgctatcaatctgattgatggtctagatggtctagttagtggtgtttcaattatcagtctagcaacgatggcagtggtttcttatttctttttacctaaaatagatttttttctcacgctaactattgttattttaatcgcctcaatagttggttttttcccttataattatcatccagccattatctacctaggtgatgctggtgccttgtttataggatttatgattggtgtattatcgcttcaaggtttaaaaaactccacagctgttgcagtgataacacctgtcattattttaggagttcctattttggatacagctgttgctattgtgaggcgtaaattatcagggaaaaagatttctgaagctgataagatgcacctgcatcaccgattgctatctatgggatttacacatagaggagcagttttagttgtttatggtattgcaattatcttttcgcttatcgctttgcttttaaatgtttctagtcgtattgggggaatttttcttctattggcgctactattagcgatggaaatttttatagaaggtttaaatatttggggtgagaatcggacaccactatttaatctcttaaagttcattggcaacagtgattacagacaaagtgttattgctaaatatagcgataagcatcaaaaataaaagcctgaaaaggcttttttagttttaatcatttagatagcagtcacacctcatttttgctataattatttagaatataatatcgggtgagtgccctataatatcttctttaaaccatagagaaatatcacatattctctgttaaccaagaaaaggagtgtacaatgtctgtacttgaaatcaaaaatcttcatgtttctattgaagataaagaaattttaaaaggtcttaatttaacgttgaaaacaggagaaattgctgctatcatgggtccaaatggtactgggaagtcgacactttcagcagctattatgggaaatcctaattatgaagttacagcaggtgaaattctttttgatggtgaagatattttagagctagaagtggatgaacgtgctcgtttgggtctatttcttgccatgcaatacccttcagaggttccagggattactaatgctgaatttatccgagcagctatgaatgcgggaaaggctgatgatgataaaatttccatccgccaatttatcactaagttagatgaaaagatggaactacttggcatgaaagaagaaatggcggaacgttatcttaacgaaggtttttcaggtggtgagaagaagcgcaatgaaattttacaactcctaatgttagagcctaagtttgccctcttggatgagattgactctggccttgatattgatgctcttaaagtggtatcaaagggagtcaatgaaatgcgtggtgaaggttttggtgctatgattattacacactatcaacgccttttgaattacattacaccagataaagtacacgttatgatggacgggaaggtagtattgtcaggaggaccagaattagcggttcgccttgagaaagaaggttatgctcaaatcgctgaagagcttggtttagagtataaagaagaagtctaatttgtcacttcaactagaagagaaaaggagttacaaatgtctaaagaagctatattaaattttttacaagccaaaggtgagcctacttggttacaagaattacgactaaaggcttttgaaaaaatagaagaactagaattaccagtaattgaacgtgtaaaatttcatagatggaatttaggtgatggaaccattttagagaatgactatacagctaacgttccagatttcacagagttaggaaacaatcccaagttggttcaaattgggacccaaaccgtccttgaacaagttcctatggaattaatagagaaaggcgttgtctttacagatttctattcggccttggaagaaattccagaagtcatagagcgctactttgggaaagcacgtccttttgaagaagatagacttgctgcctatcacacagcttacttcaacagtggtgcagtgctttatattccagataatgttgaaattactcaaccaatcgaaggtcttttttatcaagatagtcagtctaaagtaccatttaataagcatatccttcttattgttggaaagaatgcaaaagttagttacttagagcgatttgagtcaattggtgatgggacagaacgaacaagtgctaatatttctgtagaagtaattgcccaagcaggtagccaaattaaatttgcttcaattgatcgcctcggagaaaatgtgacaacgtttataagtcgtcgtggtcgtcacagtagcgatgcaacaatagattgggcccttggggtgatgaatgaaggcaatgttgttgctgactttgattctgatttaattggtgatggaagtcacgctaatttaaaagtagttgctgcctcgtcagggcgtcaagttcaaggaattgatacgcgtgttacaaactacggctgtaattcagtaggacatattttacagcatggggttattttagagcgtgggactcttacttttaatggtatcggacatattataaaaggtgcaaagggagcagacgcccaacaagaaagccgagttctcatgttatcagacaaagcacgttcagatgctaatcctatccttttgattgatgaaaatgatgttacagctggtcacgcagcctcaattggtcaggttgacccagaggatttatattatttgatgagccgaggcttgaaccaaaaaacagcagagcaattagttattcgtggatttttaggaacagtcattgctgaaataccagtaaaagaagttcgcgatgaaatgattgccgttattgatacaaaactagaaaaacgttaatatgacattactagatagttataaactaaagcaagatttcccaattttaaatcaattagttaatgatgagccgcttatctatttagataatgcagcaacgacacaaaaaccgaatcaagttttagaagctttgcgagactactaccaaaacgacaatgcaaatgtccatcgtggtgttcatactttagcagaacgagcgactgctcagtacgagaatgctcgtgaaaaagcaaggcagtttttaaatgctaaattaagtaaagaaattttattcacacgtggcaccacaacaggattaaattgggtagctaagtttgccgaaagtattttagaacgaggtgatgaggtacttatttccattatggagcatcattctaatattatcccatggcaacaagcttgcgagagaactggcgctaaattggtttatgcctatctaaaagatggttctttagatttagaagatttctataataaattatcctctaaaactaaatttgttagtttggcacatatctcaaatgtacttggctgtgttacaccagtaaaagcaatagcagaacgtgtacatcaagttggggcatacatggttgttgatggagctcaatcagcgccacatatggcgattgatgttcaagaccttgattgtgatttcttcgccttatctggccataagatgcttggtcctactggtattggtgttctttatgggaaagaaagcattttagataagatgccacctgtcgaatttggtggtgaaatgattgattttgtctatgagcaaagtgcaacatggaaggaattgccctggaagtttgaagctggaacgcctaatattgctggagcgatcgcttttggagaagctttagattatttaacggatgttggtatggatgagattcatcaatatgaacaaagtttagtttcttatgtgttgcctaaattacaggctatcgatggtttaactatttacggacctagtgatgctgaatctcatgtaggcgttattgccttcaatttagaaggtttacacccacatgatgtggcaactgcaatggattacgaaggagtggctgttcgtgcaggtcatcattgtgcacaaccccttattaatcatcttggtatccattcggcggttcgagcaagtttctatttctataataccaaagaggattgcgacaaattggtagacgctatccaaaaaactaaggagtttttcaatggcactctctaaattagataatctctacatggcagtggtagctgatcattcaaaacaccctcatcatcatggatttttagaaggcgttgaacaagtgcagttaaataatcctacatgtggagatgttatttccttatctgttaaatttgatggaaatattatttcagatattgcatttgctggtaatggttgtacaatttctacggcttcatcaagcatgatgacagatgcagttattgggaaaacaaaagaagaagcattgcagcttgctgatgtattctccaaaatggttcaaggcgatcaaaatccaaaacaagagaaacttggggatgcagagtttctagctggggtatcaaaatttccacaacgtatcaaatgtgctacgctttcgtggaatgctttaagaaaggctattgagagagataatcaggcagaactctgacaaccatagttgaaggaattacatttaaacaacttttactgacataaggtagtctagtagaagaatgtcttaaatttaaatattaaagaaaggataagtatgtccgaaataaatgaaaaagtagaaccacagccaatagatcttggggaatataaatttggatttcatgacgatgtaaagccaatttattctacgggaaaaggtctaaatgaggctgttattcgtgagttatctgcagctaagggtgaacctgagtggatgttggactttcgtctaaaatccttggaaacgtttaataaaatgccaatgcagacctggggagcagatttatcagatattgattttgatgatattatttattatcaaaaagcatctgataaacctgcgcgtgattgggatgatgttccagaaaaaatcaaagaaacttttgaaagaattgggattccagaagctgaaagagcttatcttgcaggagcatcagcacaatatgaatcagaagtggtttatcataatatgaaagaagaatatgataagctgggtattgtttttacggatactgactctgcacttaaagagtacccagagctattcaaaaaatattttgctaaacttgtccctccaacagataataaattagctgctctgaactctgctgtatggtcaggtggaacatttatttatgtccctaaaggtgttaaggtggatattccacttcaaacttacttccgtattaataatgaaaatactggacaatttgaacgtactctcattattgtcgatgagggagcaagtgttcactatgttgaaggttgtaccgccccaacttattcttcaaatagtttacatgcagctatagttgaaatttttgcacttgatggagcttatatgcgctatacgactattcaaaattggtccgataatgtctataatttagtgacaaaacgtgctaccgctaaaaaagatgcaacagttgagtggatagatggaaatctaggtgctaaaacaacaatgaaatacccatcggtttaccttgatggtgaaggagcacgtggcacgatgttgtctattgcttttgcaaacaaaggacaacaccaagatacgggtgcaaagatgattcataatgctccccatactagttcatccattgtctctaaatcaattgctaagggtggaggaaaagttgattatcgaggtcaagtgacatttaataaagattccaaaaaatcagtgtcacatatagaatgtgacaccatattgatggatgatatttcaaaatcagataccataccgtttaatgagattcataattcacaggttgctttagagcatgaagcaaaggtgtctaagatttctgaagagcaactgtactacttgatgagtcgaggtttatctgaagctgaggcaacagaaatgattgttatggggtttgttgagccctttacgaaagaattaccaatggaatatgcggtagagttaaaccgcttaatttcctatgaaatggaaggttcagttggttaattgaagatttcaagagataataaaaagcccctatgttattgatgaagggggcttttatattagcacagttattatctagagcgctttataagtaatactatcccagctaaaagacaaaggatagcgatggtgcccagaacaattaaaatagatacaaaatgtgattgaataaattgatctgtttttgtccaccactgttcttttgtttgaggctgttcttgaatagatttggttttggttttagtaacttcttttttaggtttaacggcttttaatacaggagttttagaagaaatatttttagcgtctttaaaacctttttctacaagagcgttgacaaacggatgacgatagtactctccgtcttggtctgaccaatcaccaactcctaaaaccacagttatcaagcgagtattctggcgtttagctgtaactaaggcattaaaagcagcgctagggctagaaccagtttttaagccatctactccttctaatccaaatttagcgccgggggtagagtagttataagttgtaaatgtttcttcataaggagttccgaccatggccttgacttcaggatattttgtatagttcagtatatcagggtattttttaaggaaatgataggttaaaattgatagatcacgtgcagtcgtaacgttagtagcattgttatcgtattcttttggggagtaaagtccattaaaagcactcgctaccgccccactggggttataaaagtgagtttttgtcataccgagtttcttggcggtttcattgattcgtttaatgaaggcgtcaggattgttttgtgataagtggttagcaatcataatagttgctacattagatgacgggacagctgtcatagtaatcagttcacgaataggataagcaaccccagcatgaatattattattactaatttcataaatcttacttatggcttggtctgtttctgttgcagtcactgtggtgttgaggcttgtttttcctttagctaagtcttcaaatagtaaatataaagtaaacattttagacatgctagcgggatcacgttctaaatcagcgttatcttcccacaaaatatgacctttattgtcaataacgatagacgctttaggtttattaatatctttaacatcatatccggcttctcgggtaatttgcataatatctttatgttcttcagcttgcacagagtttacacaagtcagggataataaaatgcagaggaaagatacgattaatttaggcataggtaactcctgaaaactttttattaatattataacaaaaaatcactaataaaaaagacatttcattagtgatttttaattttatatattctcctaaacctagctaaagaaactgctgtgcagcaactccttgtgtcaaagggagattactattaaagtttttcgttaacgtagcgcacaaaatgattccaccacactttgaggaagaaactgcgctcaatactatcttttgccactaaatgaacgctaggttcctttatgagatagccttttccaaccttattaaggtcaacgtaataagctttccctaggttctctttttttgtaataggagcagtaagctcttttttaaagttaatttttaactgattttgtttagtgatatttttcttctgtactactttcaaatcgtttttagcaacagcgatgaccgattgttcttttccgtctctcacacttgcttctttacctttatatgcagctcctttagctaatacaaggttaggttcgtaggtgtttgtgatatagttcaagagagagttagttgctgtaaagcgagcatatttgtctttatcggccttatcagcatgcataataacagtgagtagtctcattccactttcagtagatgtagcaataaaagattggccagctaattccgttgtcccagttttcaaacctgtaatacctggtctaaagacaggcatatctggtagcatgtagttataagaatgcataatatctttatcaaatttagcaacggacttactagtaatcttaagaatggaaggatattcgttgaccaaatggtaggcaacaatagcaatatcacgtgcactcattttattttcgtcgttttgtgacgattttggataaatgtgattgcctaacatactattatttaagccagaagcattgactaggtggctatcatgaattccccacttttccaattgagcagtcattttatcaacaaatttactttcggttcctgaaatatgttcagccaaagcaatggctgcactgttagcactagaaatcatggcagcgtccacgagctgtttaacagtatagcgccttttttctaaaggaacattactagcatcagattcgcgtgttagttgataagggtagtcagatatatttactttggtattccacttgaggttaccgttatcaatttctttatagaccatataaacggtcattattttagtcaaggaagcaatagcagcgggtttgttagcatctttttcatacaagatttttcctgaatctaaatcaactgccaaggcatgtttagcggaagcattaaaagattcagcagagatggttggcataaaaaaaatgcaactaagtaatagaatagaagtaataatttttttcaaaataacacctttagaaattttttaaactttgtccatcctattatatcatatcactatatcatactaggaattattatttttgataattaaataaagaaaacgtttgttataaaaatgtaaaaaaatgtaaaaaaatgaaagttaaaaaattatctgaaaattttgcgtttttgtcttttcttaagaattttttgtggtataatgttagtcactagataaatgaattaggagaacaaagctatggcaaaacagaaaaataactggcgccgtgttggagttggtgtccttacacttgcttcagttgcgactcttgctgcatgtggaagtaaatcagcttcccaggattctaatggagcgattaattgggctattccaacagaaatcaatacactagatttatctaaagtcacagacacttactcaaatctagctattggtaactctagtagtaatttccttcgcttagataaagatggaaagacaagaccagatttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaaataattaaattactttacactaaacctttgcaagaattggtaattgccagttcttgcttttggttaagtaaagaaagtgaaagagtttgctatttttagcaattctaagaaaaggaaatgatatgattaaatatattttaaagcgtgttgctattttgttagtaacgctatgggttgtcataaccctatcgttctttctgatgcagatccttccaggaacaccctacaataatccaaaactcactgaagaaatgatcgcattgcttaataaacagtatggtttagacaagcctgtatggcaacaatatttgacttacctttggaatgtacttcatggtgactttggaacgagttatcaatcagtgaatcagccagtatcacgtatgattagcttgagattaggagtttcagtacatctaggtgttcaggctctcgtatttggtgttttaggcggtattttggtaggagctatttcggcacgtcataagaatgataaagtcgatggtatcttaagtgttattgcaacgctagggatttctatgccttcatttatcattggtatcttattattagactattttggatttaagtggaacttgttgcctttatcaggttgggggactttctctcaaaccattttaccttctttagctctaggactccctacattagcatctgtttcacgcttcttccgtagtgaaatgattgaaactttaaattctgattatgtgcaactagctcgttcaaaaggtatgacaattcgtcaagtaactcgaaaacatgcttaccgtaattctatgattccaattttaactctaattggccctttggcggcgggtctgttaactggttctgcactaattgagcagattttctcgattccaggaattgggcagcagtttgttacttcgattccaacaaaagactatcctgttattatggggacaaccattgtttatgcagtaatgttgatggttgctatcttgataacagacgttgttattagtatcgtagacccacgtgttcgcttgcagtaaggagatgttatggcagataaaaacagaacatttaaacttgtaggtgcaggatcttctagcacacaagaaaaaattgaaaagcctgctctttcgtttatgcaagatgcgtggcgtcgcttgaaaaaaaacaaattagcagtagtttcactctatttattagctcttttacttactttttcgttagcctcaaatttatttgtaactcagaaggatgctaatgggtttgattcgaaaaaagtaactacatatcgcaacttaccacctaaattgagttcaaaccttcctttttggaatggtagcattaagtacgctggaaatacagaatctacagacgcttataagtctcaaaatgtccctgaaaaagttaagtatgctttaggtacagattctctagggagaagtgttgctaagcgcatcatcgtaggtattcggatttccttacttgtagctattgcagctacattcattgatttaattatcggtgttacatacggtcttgtttcaggttttgctggaggacgccttgatacattaatgcaacgtatcgtagaggtaatttcatcaattccaaacttagttatcgttacaatgttaggtttggtccttggtaacggtattacggctattattatctctattgcttttaccggatggacttctatgtctcgtcaggtaaggaatttaaccctatcatatcgagaaagagagtttgtgcttgctgcacgttcacttggggaaagtccaattaaaatagccttcaaacatattttacctaacatttctggtattatcattgtacaaattatgatgacaatcccaagtgctattatgtatgaagcggtactttcagcaatcaatttaggtgttaaaccaccgacagcttcattaggatcattgatttcagatgcacaagaaaatttacaatattatccatatcaagttatcttgccagctttagcattggtaatgatttcattggcatttattttgcttggtgatgggttgcgagatgcttttgatccaaaatctagcgatgaataaggaggtataatcatggaaaaagaaactattttaagtgttaataatcttcatgttgacttccacacatatgctggagaagtaaaagcaattcgtgatgtcaactttgaattaaaaaaaggtgagactcttgcaatcgttggtgaatctggttcaggaaaatctgtaactaccagaactttaattggtttaaatgctaaaaattcagagatatcagggaatgttcaatttaaggggcgtaaccttgttgaactatcagaagaagagtggactaaggtacgcgggaatgagatttctatgattttccaagaccctatgactagtttggatccaacgatgaaaattggcatgcaaatagcagaaccaatgatgattcatcaaaaaatttcaaaaaaggatgctttaaaattagctcttgagctaatgaaagatgtaggtatcccaaatgctgaagagcatattaatgattacccacatcagtggtctggaggaatgcgccaacgtgcggttatagcgattgctttagctgctgatcctgaaattcttattgctgatgaaccaacgactgctttagatgtaacaattcaagcacaaattttgaacttaatgaaaaaaattcaagcagaacgagactcctccattgttttcataactcatgacttaggggtcgttgcagggatggcagaccgtgtagcagttatgtatgcagggaaaattgttgaatttggaactgttgatgaagtcttttataatccacaacatccatatacttggggattattgaattcaatgccgacaaccgacacagaatcaggtagtttagagtcaattccgggaacaccaccagatttgttgaacccacctaaaggagatgcatttgcagctcgtaatgaatttgcattagatattgatcatgaagaagaaccaccgtacttcaaagtttcagaaacacatttcgctgctacatggcttttagatgaaagatcacctaaggtgcttcctccattaccgatccaaaaacgttgggaaaaatggaacgagattgaagggaggaaagcctaatgactgaaaatcgaaaaaaattagttgaagtcaaaaatgtttctttgaccttcaataaaggaaaagctaatgaagtgagagcaattgataatgttagttttgacatttatgaaggtgaagtgtttggattagttggggaatctggatcaggaaagacaaccgttggacgttcaattttaaaactttatgatatttctgatggagaaattacctttaatggagaagtgatctcacatctgaaaggtaaagcattacatagttttcgtaaagacgctcagatgatttttcaggatcctcaggctagcttaaacggccgtatgaagattcgtgatatcgtagcagaaggtttagatatacataaattagctaaatcaaaatcagatcgtgatagtaaagttcaggccctattagatcttgtagggttaaataaagatcatttaacacgttatccgcatgaattttcaggtggacaacgacaacgtatcgggattgcacgtgctttagcagtagagcctaaatttatcattgctgatgaaccaatatctgccttagatgtttcaatccaagcacaagttgttaatttaatgcaaaaattgcaaagagaacaaggattgacttatttgtttatcgcacatgatttgtctatggtaaaatacatttcagatcgtatcggtgttatgcattgggggaaactgttagaagttggaacatctgatgatgtttataacaatccaatccacccttatacgaagagtctattatcagctattccagaaccagatccggagagtgaacgtcaacgtgttcaccagccgtataatccagctattgagcaagacggacaagaacgtcaaatgcacgagattacccctggtcattttgttttatctacaccccaagaagctgaagaatataaaaaacaaatattataaaagatggctagcccatcttttatttttttactaataaaataaatttaggtatggaattttaaactctatgttattggtgttagccaacaggaaacttttttcagaaaatgtagaaaaagtatgaaaaaagagttgacaaagtaagagatgatgtagtaaactaaataagttgtctcgagagagcagtttctattagcgcgtagttaacaacttaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagctataatccgccatagctcagttggtagtagcgcatgactgttaatcatgatgtcgtaggttcgagtcctactggcggagtagataaagggagactaactttggttagcctttttttattggaattattatccttaagattggctagcatcttaattgtccgaatttgtcatttgttatgttataatatggatattctatattttattagggaggttttatgaaaatttttgagaaagctcctgccaaacttaatttaggattagatattaaaggacgatgtgacgatggttatcatgaattagctatgattatggttagtattgatcttaatgactacgttaccatttctgagctaaaggaagattgtattgttatcgattctgatagtagcaaaatgcctttaaataatgataatgatgtgtttaaagctgcagatataatcaaaaatcaatatggtattaataaaggtgttcatattagattagaaaaatccattcctgtctgtgcaggactggggggtggttctactgatgctgctgctacaataagagctcttaatcgattatggaatcttcaaatggactatgacgaaatggttgctattggttttaaaattggtagtgatgttccttattgtcttggtgggggatgttcgttagtattaggtaaaggtgaaattgttaaacccttaccgacattgagaccatgttggatagttctggttaagccggattttggtatttcaactaaatccatttttagagatattgattgtaagtctataagtagagttgatattgatttattaaagtctgctattttgtcatcagattatcagttaatggtcaaatctatgggaaattcactcgaggatattacaattactaaaaatccagttataagtacaataaaagaacgtatgttaaattctggagccgatgttgcattaatgacaggaagtggaccaactgttttttcaatgtgttctacagagaaaaaagctgatcgtgtttttaatagtatgaaaggtttttgcaaagaagtttataaagttaggttgttgagataaaaggttttatcttcttcacctatctatgattgattcttctatatcttcgtgatataatttactggttaacaaaaaagaggtatatatgacagttttagaacaaaaattagaccatttagtgagtcaaatcttgcttaaagcagaaaatcaacatgaattattgtttggtacttgtcaaagtgatgttaaattgactaatacgcaagaacacattctgatgcttttatcacaagagcagttgacaaattctgatttagctaagaagttaaatattagtcaggcagctgtaactaaagcagtaaaaagtttaatttctcaggatatgttgaaagcgaataaagattctaaagatgctcgtattacttattttgagttatctgaacttgctaaacccattgcagatgaacacacacatcatcatgacaatacgttaggggtttacggaagattagtaaatcatttttcaaaggacgaaaaggtcgttttagaacgttttcttgatcttttctctagagaattagaagggtaatcatgcgatatattacagttagtggtcttacttttcagtacgatagcgatcctgtgctggaaggggttaattaccatttagacagtggggagtttgttaccttaacaggtgaaaatggggctgctaaatcaactttaataaaggctactttaggtattttaacgcccaaagtgggtacagttaatatctctaaagaaaacaaagaaggaaaaaaattacgtattgcctatttacctcaacagattgcaagttttaacgctggctttccatcgtcagtttatgaatttgtgaaatctggacgataccctagaaatggttggtttagaagactgactaaacatgatgaagaacatattagggttagtttagaagctgttggtatgtgggataatcgccataaaaagataggaagtttatctggcggtcaaaagcagagggctgtcattgctaggatgtttgcttctgatccagatatttttgtattggatgagccaacaactggtatggacgcagggactactgagaaattttatgagttaatgcatcataatgctcataagcatggtaagtctgttttgatgattactcacgatcctgatgaagtaaaggggtatgctgaccgaaatattcatcttgttaggaaccaatctttaccatggcgttgtttcaatgtccatacaaacgaaatggaggttgaatcagatgctacttgatatgctttcctatgattttatgcaacgagcgctcttagcagttgtggctattagtatttttgctccaattttaggcatcttcctaattttacgtcgtcagagtttgatgagtgatactttgagtcacgtttccttagccggtgttgcattaggcgttgttttaggtatctcgcctacatggtcaactattttcgttgttactttggcggcagttgtattagagtatttgcgtactgtatacaaacattatatggaaatatcaactgctatcctgatgtcgatggggttggctatatctttaatcgttatgagtaaagctcataatgttggtaatgtcagtcttgaacagtatttatttggttctattattactattgggaaggaacaagtgattgctttgtttgttattgcattaatcacttttattttaaccatcctatttattagaccaatgtatatattaacgtttgatgaggatacagcttttgtagatggattgcctgtgcgtacaatgtctattttgttcaatgttgttacaggtattgctattgcattaacaattcctgccgcaggtgctctattggtgtcaactattatggttttaccagctagtattgctatgcggttaggtcgaaattttaaaactgttatttttctgggtatgttaattggatttgtgggaatggtagctggtattttcctttcgtattattgggagacacctgctagtgcaacaataacgatgatttttattggcattttcctattagttagcttagtaggcttgcttcgcaaacgttaaataaaaaaatctatcttattctaggatagattttttatttatctccctgtttttttcgaatatattttatgagggatcagttgagaaattatctcgatgaggtatctactaagttttctggcttaagttgatagaaggggcaatgtgaatctatttttgcgttttaggataaaaaatactaccggcaattttgccggcagtaaattgtaattattgtgcttcagtagtgctgtgatgtttgtgttgatttaacgcttcttgttcagtcatttgaacgatattagcggtatttgcattttttatgttttctaaactataccaataagtatttgaacgacccttatttgcaacgtagacgattctattttggggagctacattatttgtatctgattcagaagtattagtgttagtattttcttctatatcagatgcactttcaatagctgcttcgttttcatcagcatcgctatttggatcttcaccttcttctgcctgtttcccatcttctttgattagcataccagttttgtaatcaatttttgcgagtggagacgtattttctaatgtaacagttgtgacgccgtattcatcaacttgttctttgccgccgcctaatttgatttctagaagttttccttgtttatcaattccaacatactgaagttcaactcggctaggtactaaattatttccttcgtatattggagtcactttgtaatcaagctagaaatttttatgatttgccaaccaactatctaatctattttcgtagtataacataccatcaggattattttcgctaaatcctgtatttagatatttggtcatagtaactaggttctcaggaacattgttcattcctgaaaattgataaccaacgaggtgacctcggtctataagccaagttgttttacccttttcagtagtaaatttgtagttgtgccaaccggttggattatacgtcagtctttctctttttatcttaggctcatctgcatcccttaattgtatgtgagaatatgttgctctttctaagttatctaatgaacctaccttgatttgcttattatgagtaaacggtaagatttttttgaagaagtacttacatactgtgtctcaacatgggatgtcgtcttataatgtttagccttagcttcaacattctgttgtaatgccccaacgcatagtacgacagttaatagtggtagtgatttgtataattgtttagataatttcataaacctaaacccttctaaatgatatttgtgaaggcctttcacaagtataattttatcattttattgggaaaaagtaataaaaaaacataactagttaattttttttggagattatgttatttaactagatagttattaaagttaaatgttatagatatactgttattacataataatttttatatgatttgttattttattagattttttaatggattatttctttagctgattttgattacaaagttaaggtattctaatcatattttcttgatttataacatgtaaaggttagaataaattcgttggtgttagacagacgatatttgttgtttttatgaaaaaattgtgggtattagatatgtatattttttcgataactatttactctatggtaaaaattctaagctgtttgtttggtgttatttcttaataaaaataaggtagtcatgtataataactataatttaaaagttgtctcttcaggaatgttgttcattaataaaaagtgtagtcaattgactacactttttattgtcttgaaatattattatcagagtatcgattacacttcaagtctatttaaagtttaatacaaagtattttttctttccacgacgaatgactgtaatttcattttcaagcttatcattttctgagatagtatattctaaatcttgaatacgatctccattaatataaatagctccattggagacatcttctcgagcttgacgtttagaattgacaactcctgaagtgactagaaggtctatgatattgaggttatcttccgtctgaacgtgataatttggtactccacgtaaaccttgtttgagctctttaacagacaatccttttatattgccagcaaatagctgttccgtgatattaacggcctccttataagctttttcaccatgaacaagagttacaacttcacgtgctagtgttttttgtgctaagcgttggtgaggtgcttcctcgaattgaatacgtatatcttctatttctttaaggcttaggaatgtaaaaatcttaaggaagcgaacggcatcagcatccataacattgagccaaaattggtacatttcataaggagaggttttgtcagcatcaagccaaacagcatttccttcagattttccgaatttttttcctgtagaatctgttatcaatggaacagtcataacatgagatacaccatttgattttcgtctaataagttcggttccagcagtcatgttgccccattggtcagaaccaccaatttgcaaagtgacattatagttcttatttaattcgtaaaagtcatatccttgcataatttgataagcaaattcagtataggaaatccctgtttcgatacgttttttaacagattctttactcatcatataattgacagtaaaatatttaccaacatctcgtaagaaatcaatgaaactaatattgctgaaccaatcataattatttaccaatacagctttgttatcacctgtttcaaactctagaaaattagataattgaccgcggattttattaccccaactaactacagttttctttgtttgtaaactgcgctcaacatctttaaatgaagggtccccaataagtccagttgcgcctcccacaagtgcataaggcttgtgaccagcaagttgtaagcgacgagaggttaaaatagcaactaaatgtccaagatgaaggctgtcagccgtaggatcgtagccagtatagtaagagacagaaccttcttcaagagctttgcgtaaagcatcttcgtcagttgtctgaaaaacgagtccacgttctttgagttcatcaaaaatattcatctttttctcctaattattaacttgttgtgtattaatgtcaactatatcaaaactctttaggatatgcaagttatattaaatctgatataatgtaggatgaggtattattcatgtttaaaggtaataagaagttgaatagttctaaattaggtgattacacaccacttgaatttggttctatttttttaagaattgtaaagcttttatcagatttcatctatgttattattttactatttgttatgctcggagtaggacttgcagtagggtatcttgctagtcaagttgactctgttaaagtaccaagtaaaaatagtttagtgacacaagttaatacacttactagggtgtctaggttaacttattctgataaatcacaaatttcagagattgccactgatttacaacgtacaccagtggcaaaggatgctatatctgataatattaaaaaggctatcattgcaacagaggacgaaaatttcaatgaccataaaggtgtagttcccaaagccgtactacgtgctgcagcgggatctgttctggggtttggagagagtagcggtggttcaacgctgacacaacaattattaaagcagcaaattttgggagatgatccgtcatttaaacgcaaatcaaaagaaattatttatgctctagcattagagcgttacatggataaggattcgattttatcagattatttaaatgtatcaccgtttggtcgcaataacaaaggacagaatattgcaggtattgaagaagcagcacaagggatttttggagtttccgcaaaagatttaacaattcctcaggcagctttccttgcaggtttaccgcaaagtcctattgtatattctccttatactgcagatgcccagttgaaatcagataaagatcttagttttggtataaagcgccaaaaaaatgtgttatacaatatgtatagaacgagagctttaaccaaagatgagtacaaatcctacaaagattatgacatcaaaaaagattttatcaaacctgcagtggcgacaacaaatcatcatgattatctttactactcggcattatctgaagctcaaaaagtgatgtacaattacctcattaaaaaggataatgtttcagagcatgatttaaaaaatgatgagactagagcgacgtacagacaccgcgctattgaagagattcaacagggagggtatactattaaaactactatcaataaatctgtttatcaagccatgcaggatgctgcagctcaatacggagggttgttagatgatggtactggcaaggttcaaatgggaaatgtactaacggacaattctagtggtgctattataggatttattggtggtcgtaactatagtgagaatcaaaataaccatgcttttgatacggcacgctctccagggtcaagtattaaaccgatattaccttacggaattgctattgatcaagggatgttaggaagtggtagtgttctttcaaattatccaacgacatattcaagtggcgaaaagattatgcatgcggatgaagaaggtactgctatggttaaccttcaagagtcattggacatttcttggaacattccagctttctggacttacaagatgctacgagatcgaggcgttgatgtaaaaaactatatggagaaattagactatccaattgaaaactttggtatagaaagtttaccacttggtggtggtattgatacgtcagttgctcagcaaacaaacctttatcaaatgattgcaaatggtggtgtttatcataagcagtatatgatagaaagtatagaggatagtaatgggaaagtgatttataatcacgaaagtaaacctgtccgtgtcttttcgaaagcaacagctactatcttacagcagctattacatggaccaattaactccggaaagactacaacctttaaaaatcgcttacaaggtttaaatagtggtttagctggggtagattggattggaaaaacgggtactactaactcaacttctgatgtttggttgatgctttctacacctaaagtgactttaggtggatgggcaggacatgataataatgcctctttagcgaaattgacaggttacaataataatgctaattatatggctcacttggttaatgctattaataatgcagatggcaatacttttggtaagtcagaaaggtttagacttgatgatagcgttataaaagctaaagttcttaagtctacaggtttacagccaggtgtagtaacagtaaacggtcgtcgaatcactgttggaggtgaaagcacaacaagttattgggcaaaaaatggacctggaacgatgacctatcgttttgctattgggggaactgatagtgattatcaaaaagcttggtctactttgggtggaaaacgataacaggtttacgatactgatagttttatttgaggagaatagagtgatctgttctccttttattttttccaagataatatgatttaattcttgtatagtcttctttcaaagaattagaaaaacaccagtatgctatgtttaaaaatcatcgtgttatgctaaaactcaagggtgttgatgaacaaattgaaattctagaagcttccttgaagtcaagagaataaaacttgatttattggtgaaaataagttataatgtacgtaactatttgtcgtctgtctaggttgaaatattgtccgacctagatatacagcagttaaatcaacttgataaagtgagatttagctgctctttttgtgcctaattttaagaaaaaaggttattgtaatatatatttaaactttctgaaaattaccacaaacgacatctataagcttgttcttgttaggcgagcaaatgaaataaactcactaagttttatgagataaaaacttagtcactctatctttaaaaaggagctaaaaacttggcaggacatgaagttcagtacggaaaacaccgtacacgtcgtagcttttcaagaattaaggaagttcttgatttaccaaacttaattgaaattcaaactgattcattccaagattttcttgatgctggcttgaaagaagtatttgaggatgtacttccaatttcaaactttacagatactatggatcttgaatttgttggttatgaattaaaagaacctaaatatactttggaagaagctcgtatccatgatgctagctactcagcacctatttttgttactttccgtttagttaataaagaaactggtgaaattaaaactcaagaagttttctttggtgattttccaattatgactgaaatgggtactttcatcatcaatggtggtgaacgtatcattgtttcacaattagtccgttctcctggtgtttactttaatgataaggtagataaaaatggaaaagttggttatgggtcaactgttatccctaaccgtggagcttggttggaacttgagacagacgcaaaagatattgcttatacacgtatcgaccgcacacgtaaaattccatttacaacactagtccgtgcacttggtttctctggagacgatgaaattgttgacatctttggtgacagtgaacttgttcgcaatactattgaaaaagacattcataaaaatccaagtgattctcgtacagatgaagcacttaaagaaatctatgaacgtcttcgtccaggtgaaccaaaaactgcagacagctcacgtagtcttttagttgcacgtttctttgatccacgtcgttatgacttagcggctgttggtcgttataagattaataaaaaactgaatcttaaaacacgcctattgaaccaaacaatcgctgaaaatttagttgatggtgaaacaggagagattcttgttgaagctggaaccgttatgacacgagatgtcattgattcaattgcagagcatatcgatggagacttaaacaagtttgtctacacaccaaatgattatgctgtagttactgaaccagttattcttcaaaaattcaaagttgttgctccaactgatccagaccgtgttgttactattgttggaaactcaaatcctgaagataaagttcgtgccttaactcctgcagatattttagcagagatgtcatacttcttaaaccttgcagagggtatcggtaaggtagatgacattgaccatttaggtaaccgtcgtattcgtgcagttggtgaattacttgcgaaccaattccgtatcggacttgctcgtatggaacgcaatgtccgcgaacgtatgtctgtacaagacaatgaagtcttgacacctcaacaaatcattaacattcgtccagtgactgccgccgttaaagaattctttggttcatcacagctgtcacaattcatggaccaacacaaccctctatcagaattgtcgcacaaacgccgtctctctgccttaggacctggtggtttgacacgtgaccgtgctggatatgaagttcgtgacgtgcactatacccactatgggcgcatgtgtccgattgaaacacctgaaggtccaaacattggtttgattaataacttatcttcatttggacacctcaataaatatggatttattcaaacaccatatcgtaaagtagatcgttctactggtgcggtaacgaacgaaattgtttggttgactgctgatgaagaagatgaatttacagttgcacaagccaactctaagcttaacgaagacggtacatttgcagaagaaatcgttatgggtcgtcatcaaggtaataaccaagagtttccttcaagcattgttgactttgttgacgtgtcacctaagcaagtagttgctgtcgcaacagcatgtattcctttcttggaaaatgatgactctaaccgtgccttgatgggtgccaacatgcaacgtcaggctgtgccattgattgatccaaaagcaccatatgttggtactggtatggagtatcaagcagcccacgattcaggtgcagctgtgattgctaaacatgatggtcgtgttattttttcagatgctgaaaaagttgaagtgcgtcgcgaagatggttctcttgatgtttatcatgttcaaaaattccgccgttcaaactcaggtactgcttataaccaacgtaccttagttaaagttggtgatctcgttgaaaaaggtgattttatcgccgacggaccatctatggaaaatggtgaaatggctcttggacaaaacccagttgttgcttatatgacttgggaaggttataacttcgaggatgccgttatcatgagtgagcgccttgtgaaagaagatgtctatacatctgttcacttggaagaattcgaatctgaaacgcgtgatacaaagcttgggcctgaagaaattactcgtgaaattccaaatgttggtgaagattcactacgtgatctcgatgaaatgggaattatccgcattggtgctgaggtaaaagaaggtgacattcttgttggtaaggtaacacctaagggtgaaaaggacttatctgctgaagaacgtctcttgcatgccatttttggtgataaatcacgtgaagttcgtgatacttcactacgtgtacctcacggtggcgatggagtagttcgtgacgttaaaatctttactcgtgcaaatggtgatgaattgcaatcaggtgttaatatgcttgtccgcgtttatatcgctcaaaaacgtaaaatcaaagtcggtgataagatggccggtcgtcacggaaacaaaggtgtcgtctcacgtattgttcctgttgaagatatgccttacttaccagatggaacgccagttgatatcatgttgaacccacttggggtgccatcacgtatgaatatcggacaagttatggagcttcatttaggtatggctgctcgtaatttaggtattcatattgcaacgccagtctttgatggggcttcttcagaagacctttgggaaactgttcaagaagcaggtatggattcagatgctaagactgttctttatgatggtcgtactggtgaaccattcgataaccgtgtgtcagttggtgtcatgtacatgatcaaacttcaccacatggttgatgataaacttcatgcccgttcagtaggaccatactcacttgttactcaacaaccacttggaggtaaagctcaatttggtggacaacgttttggtgagatggaggtttgggcgcttgaagcttatggtgcttcaaatgttcttcaagaaattttaacatacaaatctgatgatgttacaggacgtcttaaagcttatgaagctatcacaaaaggtaagccaattccaaaaccaggtgttccagaatcattccgtgttcttgtaaaagaattgcaatcacttggtcttgatatgcgtgtccttgatgaagatgacaacgaagttgaactccgtgatcttgatgaaggtgaagatgatgatgtgatgcacgttgatgaccttgaaaaagcacgtgtgaaacaagaagctgaagaaaaacaagctgaacaagtatctgaagtcgttcaagaagattaaatttatctagtttataactagaagcgaatatagaattgatatgcaatgctagtcctaggatttattgaaatcctagctgggctagtatgatgataaatcgaagaaaggtaaaactagtggttgacgtaaatcgttttaaaagtatgcaaatcacattagcatcaccaagtaaggtccgttcatggtcttatggtgaagttaaaaaacctgaaacaatcaactaccgcacattgaaaccagaacgtgaaggactttttgatgaagttatttttggtccaacaaaagattgggaatgtgcgtgtggaaaatacaaacgtattcgttacaaaggaatcatttgtgaccgttgtggcgttgaagtaacccgtgcaaaagttcgtcgcgaacgtatgggacatatcgagttaaaagcaccagtatctcatatctggtatttcaaaggtatcccatcgcgtatggggctcacattggatatgagtcctcgtgcacttgaagaagttatttattttgcggcttatgttgttatcgatccaatggacacaccattagaaccgaagtcactccttactgagcgtgaataccgtgaaaaacttcaagagtacggttacggttcgtttgttgctaaaatgggtgctgaagccattcaagatcttcttaaacgcgttgatttagatgcagaaatcgcagttcttaaagaggagttgaaatcagcgacaggtcaaaaacgtgtgaaagcagttcgtcgtctggatgtgttagatgcctttaaaaaatctggaaataaaccagaatggatggttcttaacattttaccggttatcccaccggatcttcgtccgatggttcaattagatggtggtcgttttgcggcatcagacttgaatgacctttaccgccgtgttattaaccgtaacaatcgtttggcacgtttgttggaattaaatgctcctggcatcatcgttcaaaatgaaaaacgtatgttacaagaagctgttgatgcgcttatcgacaatggtcgtcgtggtcgtccaattaccggaccaggtagtcgtcctttgaaatcattaagccatatgcttaaaggtaaacaaggtcgtttccgccaaaacttgcttggtaaacgtgttgacttctctggacgttccgttattgctgttggtccaacactcaaaatgtaccaatgtggtgtaccacgtgaaatggctattgagctcttcaaaccttttgtaatgcgtgaaatcgttgctcgtgacctcgcagggaacgttaaagcagctaaacgtatggttgaacgtggggacgagcgtatttgggacatcttagaagaagttattaaagagcacccagtacttctaaaccgtgcacctactcttcacagattaggtatccaagcgtttgaacctgtccttattgatggtaaggcgcttcgtcttcacccacttgtatgtgaggcctacaatgctgactttgatggagaccaaatggccatccacgttccattgtctgaagaagcccaagcagaagctcgtcttttgatgcttgctgcagagcacatccttaaccctaaagatggtaagccagtcgtaacaccatctcaggacatggttttaggaaattactacctgactatggaagatgctggtcgtgaaggtgaaggcatgattttcaaagatcatgacgaagcagttatggcatatcaaaatggttatgttcatttacatacacgtgttggtatcgctgttgattcaatgccgaataagccttggacagaagagcaaaaacataaaatcatggttacaacagttggtaagattctcttcaacgatatcatgcctgaagatttaccgtacttaattgaacctaataatgcaaacttgacagaaaaaactccagataaatacttcttagagccaggtcaggatattcaagcagttattgataacttagagattaatattccctttaagaagaaaaatcttggtaatattatcgcagaaacttttaaacgtttccgtacaacagaaacttctgctttccttgaccgtttgaaggaccttggatattatcattcaacacttgctggtttgactgtgggtattgctgatatcccagttattgacaataaagctgagattattgatgcagctcaccacagagttgaagatatcaataaagccttccgtcgaggtttgatgactgaagaagatcgttatgttgctgttacaacaacatggcgtgaagctaaagaagcacttgaaaaacgtcttattgagacacaagatccaaagaaccctatcgttatgatgatggactcaggagctcgtggtaacatctcaaacttctcacaacttgccggtatgcgtggtttgatggctgctcctaacggacgtatcatggaattgccaatcttatcaaacttccgtgaaggtcttagtgttttggaaatgttcttctcaactcacggtgcgcgtaaaggtatgactgatacggcccttaagacagccgactcaggttaccttactcgtcgtttggttgacgttgcccaagatgttattattcgtgaagatgactgtggaacagaccgcggtttgacaatcacagcaattacagatggtaaagaggttactgagacacttgaagagcgtttgataggacgttatactaagaagtcaatcaaacatcctgagacaggtgaaattctcgttggtgcagataccttaattactgaagatatggctgctaaagttgttaaagcgggcgttgaggaagtaactatccgatcagtatttacatgtaacactcgccatggtgtttgtcgtcactgttacggtattaacttggcaacaggtgatgctgttgaggttggtgaagcagttggtactattgcagctcaatctatcggtgaaccagggacacagcttacaatgcgtaccttccataccggtggtgttgcttcaaatactgatattacacaaggtctcccacgtatccaagaaatctttgaagcacgtaaccctaaaggtgaggcagttattactgaagttaagggtgaagtcgttgcaattgaagaagactcttcaacacgtactaagaaagtattcgttaaaggtcagacaggtgagggagaatacgttgttccatttacagcacgtatgaaagttgaagttggtgatgaagtagctcgtggtgcggccttaactgaaggatctatccaaccaaaacgtctccttgaagttcgtgatactttatctgttgaaacgtacctacttgctgaagtacaaaaagtttaccgtagccaaggggtagaaatcggagataaacacgttgaggtaatggttcgtcaaatgctccgtaaagttcgtgtcatggatccaggagatacagatcttcttccaggtacacttatggatatttcagactttacagatgctaacaaagatattgttatttctggtggaatccctgcgacaagccgtcctgtccttatgggtattactaaggcttcccttgaaactaattcattcttatcagctgcatccttccaagaaacaacacgtgtccttacagatgctgctatccgtggtaagaaagatcacttacttggtcttaaagaaaatgttattatcggtaaaatcattccagcgggtactggtatggctcgttaccgtaatattgaaccacttgctgttaatgaagttgagattattgaaggaactcctgttgatgcagaagttacggaagtatcaacacctacaacagaagattaatcaaaaagaacttgagtttaactcaggttctttttttacaagaatttggaatgagcagatattttttattttattcttattttttatataatactctctaaaggaagtgtattatgtatcaagttgtaaaaatgtttggtgattgggaaccatggtggtttattgaaggttgggaggaagatattactgaaattgctgagtatgataccttatcagaagctttgctctattttcaagaggagtgggataggggacaggaaaagtggccttattttcaaagtaagtctagtttgttggcaacgttttggagtataaaagaaaaacgttggtgtgaagaatgtgatgagtacctccaacagtatcattccttaatgttattgaaagaatggcaagaaattcctaaggaagaatctattgagcgatttgaagtatttaataagatagctgagttgccatcggcatgttctttaaatttgtaattaaaagtagtttaaaaaagttagatagtttttatggggatataataggtttgttcagcctctgcttcataatatttatgttactacctctcaagaaatcattgaaaagatctcaccaattggtgagatttttttattttattttcgaatatatggttaaggaggttacgggatggttcaatcattagcaaagcaagtcattcatcaggcagtagaagtaaatgctcaagatatttatatcattcccaaaggtgattgttatgaactctatatgcgtattgatgatgaaaggcggtttattgatgtttttgagtttaataggatggctagtcttattagtcactttaaatttgtggcaggcatgaacgttggagaaaaaagacgaagtcaattaggttcttgtgactatgaactgtcagagggaagactggtttcattacgactatcgagtgtgggagattatcgtggtcaagaatctttagttattcgtattttgtattcaggtcatcaggacttaaaatattggtttgataatataaagcaaatgaaggaagtactgggtataagagggctatatcttttttccggccctgtggggagtggtaaaacaactctcatgtatcaattagcttcagaagtatttaaaaataagcaaattatcacgattgaagatccggtagaaatcaagaatgacaagatgttacaactccaattgaatgaggatattggaatgacttatgatgctttaatcaaactgtctttacggcatcgtccagatattttaattatcggagagattagagatcaagcgacggcccgtgctgttattcgtgcaagtttaacgggagtgatggttttttctactattcatgctaaaagtattcccggagtctatgataggcttatagaattaggggttaactatcaagagttagaaaatagtctaaaattaatagcatatcaacgtttaattggaggaggaagcctaattgactttgagacaggtaattttaaaaaacactcatcagacaagtggaatagacaagtggatatcttggctgaagaaggacatatcagtaagaaacaggcacaagtcgaaaaaattatccctcaagaaacaacggaaagtagtccaactttttaataatctttttgctagtggtttttctttaactgatatggtcaccttcttaaagaggagtaagttattgtctgattgttatacagatagtatgaataaggcattattagagggaaaagatttatcaaaaatgttaggagagttaggtttttctgacactgttatcacacaggttgcattagctgatttgcatggtaacatttcaaggagcctactaaagattgagtcttatttagctaatcttttgttagttagaaaaaaagtaatagaagtagctacttacccattgatattattgtcttttctggtgctaattatgattggccttaggaattatttaatgccccaattaggagaaaataattttgcaactagactgattacaaatgtgccgaatattttcttattacttttagcagttgtacttatttttagtttaatattttatattattcaaaagcgattgtcgcgcattaaagtagcttgttttttaacaacaattcccttagttggatcatatgttaagctttatttaactgcttactatgcccgtgagtggggaaatttattaagtcaaggtattgaattggaccaaattgttaaagtaatgcaaaatcagaaatccaaactttttagggaaataggatatgacatggaagaaggttttctatcaggtaaagcatttcaccaaaaagtattagactatccgtttttcttaactgagcttagtttaatgattgaatatggccaagttaaggcgaaattaggaacagagttagatatatatgctgatgagaagtgggaggatttttttacaaaattagctagagcgacccagttaatccaacccgttatttttatttttgtagctcttatcattgttatgatttatgcagcaatgctgttaccaatgtatcaaaatatggagatattatcatgaaaaatttattgttaaaatgtaaggataagaaggttaaagcatttacacttttagaatgtttggtagcattggttacaatcacaggagctttactagtttatcaaggactgacaaaattgttggctcaacagatagtagtgatgtcttcttccagtcagtctgaatgggtgttattaactcagcaactaaatgcagaatttgaaggcgctcatctggaatatttaagacagaacaaactttatttacgtaagcaagataagattgtaacctttggcaaatctaataaagatgatttccgtaagacaggttatgatggtcgaggttatcaaccaatggtttatgggttagacaattgtcaaatgagtcagaccaaaagtatggtaaaacttgttttttattttaaggacgggttaaaaaggacattttactatgattttaaagaagaaacttaaagctggcatccttttgcaagctattgtattggctgctgtatttacactcgtcttacagttttatctagcaagaatattggcaacagaaagacagtatcatagccaaattgaagcaagtaaagcttatttaacagcgcagttagcttataaaacaatagaaggtgactccatatcaggaaaatgttattttacaggaggatatgcttcatacctccaagaagggaactatttacaagttaaggttacattggataagggaggaaactataaccataagttttatcgtaaaacagacactctccaagtacctctcaagtctaatgataataaagcaagccataaacattaaaaatatacagtgatgaaatattagtaagacaaggttttgcttaaaaacaggatttttgtttgcttctcttttcagatgctgtgttttttgttatgataaattctggaggaaatcatgaattttgaaaaaattgagacagcctatgagctgattttagaaaatatccaaacgattgagaaccaattaaaaactcatatttatgatgccttaattgaacagaactcttattaccttggttcaagttgtgatttagatatggttgtggtgaataaccaaaaattacgtcaacttgacttaagtcaagaagaatggcgtcgcactttccagttcatttttatcaaatctgcgcaaacagagcaattacaagctaatcatcagtttacgccagatagtattggttttatcttgttatttcttttggaagaattaacgagtcaagagacagtggatgtcttggaaattggaagtggaactgggaatttagctcagactctcctcaataacagctcgaaagagttaaattatatgggcattgaagttgatgatcttttgattgatctatcagcaagcattgctgaaattataggttctagtgcccaatttatccaagaggatgctgttagaccacaaattttgaaagaaagcgatgtaatcattagtgatttaccagttggctattatcctaatgatggtattgctaaacgatatgctgtatcaagttctaaagagcacacctatgctcaccatctattgatggagcaatctcttaaatatttgaaaaaagatggaatcgctatatttttagcacccgaaaaccttttaacaagtccacaaagtgatttgctgaaggagtggttaaaaggatatgcagatgtcattgccgttttaactctaccagaaactatttttggaagtcgtcaaaatgcgaaatctatatttgttctcaagaagcaagcagaacaaaaaccagaaacctttgtatatccgctgacagatttgcaaaatcgtgagaatatggcaaacttcattgaaaattttcaaaaatggagcagagaaaatagtcattactcaaaaaatatgataaaatagagattgtgaaaacgctttagagaggtaaattatgtcaaaaacaatagcaattaatgctggaagttcaagtttgaaatggcaattatatgaaatgccagaggagaaagtagttgccaaagggattatcgaacgtattggtttgaaagattctatttcgactgtaaaatttgacgataaaaaagatgaacaaattttagatatcgtagatcatacccaagctgttaaaattcttttagaagatctaacaaaacatggtattatcaaagactttaatgaaattacaggtgttggtcatcgtgtcgttgctggtggtgaatattttaaagagtctgctttagtagatgataaagttgtagaacaggttgaagaattatcagctttagctccactccacaacccagcagctgcagcagggattcgtgcgtttagagaaatcttaccagatatcacgagtgtatgtgtatttgatacagccttccatacaacaatgcaacctcatacctacttatatccaatcccacaaaagtactatactgattataaagtacgtaaatacggtgcacacgggacaagccaccaatacgttgcacaagaagcagctaagcaattaggacgtcctttagaagaattaaaattaatcacagcacatgtgggtaatggtgtttctattacagcaaattatcatggacagtctattgatacatcaatgggattcacaccacttgcaggaccaatgatgggaacacgttcaggagacattgatcctgcgattatcccttatcttgtagctaatgatccagaattggaagatgcagcagctgttgttaatatgcttaacaaacaatcaggattgcttggagtatcaggaacttcaagtgatatgcgagatattgaagcaggtcttcaaagtaaagatccaaatgcagtgttagcctataatgtctttattgaccgtattaagaaatttattggacaatacttggcagtattaaatggcgcggatgctattatttttactgcaggtatgggagaaaatgcgccattaatgcgtcaagatgttatcgcaggattatcatggtttggcattgaacttgatccagaaaaaaatgtttttggttattttggagatatcacaaaaccagattcaaaagtgaaggttttagttattcctactgatgaagaattaatgattgcgcgtgacgttgagcgccttaaagctaaataagttatcaaaaaattgataagaccagaaaagttgatagtttaactatcaacttttttgtcttttgaacagatatgtaaaatgtacttgacaaaaaatgtatagttaactatactatgaatgtaaagctaactatacaaaaaaggtgtaagatatgaaaaattctctacaaaagttacgaaaatctaggaaattaagtcaagcagaacttgcagttgcacttggagttactaggcaaactattatttctctagaaaaagagaaatacacggcatctttggagctagcatttaagatagcgcgttattttgataaacaaattgaggaagtttttatttatacagaaagtgaaggaggatagaattttaatggaaaaatacagtccacaaaagacaaaaggttaaaagttaatctgtaatatgtcaaggatgtggactattgatttttgtccaccaatcgtttaccagcaatatgtttttatcattactattagtattagcattgcgatgtctatttttgctatttatcgctatgcttcattgaagaaaacgatataatagctgatgattaaattgaagttttagaaagtagtattctatgttaataaaaggattattgtcacccaatagtaaagtatctccgaaggattacaaagtatatatgagagttttgtcttttgtttttagtgtatgtagtttgattatgatagtatcatcatttctacatacctttgaatctaattttactaaaggtttttcctttggttcaggtattgccttatttgcaggaagtttttattttttggtgataacatttagtgaaaagcgatttcaacattactataccaaagtttttgatgagcgtaatcaatttattgctaatatgtcttgtcgacttcttttccttttatctgtccttgttttagtggtattgtgtctgattaatgtctggtttggtataactttttcctatgcaaagttcttgctattgatactctcttttattttatatggttatttattaatttactttattttacagaagttattgtgagataagtctataagatttgaaaatatgttatgatagaaaaaagttaataatttattttggaggtttttgtgtcatttattattagaaaaggcaaaattttagctttgctaatagcatttttagttattaatcaacttgttcctatattggctgtgtggctcctaaagaatcactatcaaacgccttttactagtatattgttgattggcttagaattacttattattgctcttttcctttattatgccaaggttaaacaaataatcagatggaaagcattattgacaaggaaagcattagttactattctcttaggttggttatcattgagggttccacaaattattggttacctcattatgactatgcaaggggttaaagatacagcaaatcaaacagtaattatggaattaacaaagcaacttccactagctttgatgttaatttttgccataattggtgcccctattatggaagaaattatatttcgctatattatccctaaagaactttttgcgaaacatcaaaaatggggttttgtcatcggtactttagcttttgctcttattcattccccttctgatataggtagttttattatttatgctgggatgggtgctattttatcttttgtttattataaaactgagcacttagaatatagtataatgattcattttattaacaatgctcttgcttatagcgtgttaatcagtacaatgatgaataactaaaaaaactttgagcaatttgctcaaagtttttttgctttctcaatagtagcatcaatggcagaaataacactatgcgtcagaccatttttttctaagtctaaaaggccagcaatagtagttccgcctgggctacaaatgttgtcgattaagtcagaggtgctattttgtccttgtaataggttttgactagaagctaagacagtctgtcctacaatagagagtgcttgttcttttggaaatccatattttacacctgctttagctaaggcttctataaatagatagatataggcagggctagaacctgctagagcagtgaaggtatcaaaattggtttctgctatatcaaagctacttccaaaactatccgtaatttctttggctaattgtcgtaactcatctgatacatgattgttgtaacaaatagctgtgcaactttgaagtatttgtgcgttaatatttggcataatacgaatcaatggtaaatcagaacgagttaattggcttaaacgcgctaaggagattcctgctgccattgagatgattggttttgtgatatcaagtggaagaagaaccttttcaaatagttgaggtttaatacctaacatgataatatcagcttgattgattaatgactgatgagattcggcgtaagtaacatcaagtctttctgcaatttcttttgaacgctctaagcaagatccggatatgataatgtcatgttgggtttgtttgaggccttgaataattgcactggccatttttccgacgccgataattccaattttcataatgttgatatggggatgaaaggagatactaaaatgtgtctaccttatgaaactcccatcctttctatcttaataacctttaataatatccaccgtcgagcggtctaatttgttaacgatggcctgaaggtaagcttgtgcttgtagaaaatcatccatagcgtagagtgtttgatgagaatgaatgtagcgtgcacagacaccgatagttgtagaaggaataccactattttttaggtgagcagccccagcatcggtaccaccatttgcagcataatattggtattttatacctgcttcttcagctgttgtaagtaagaaatctctcatatctttaagcatgatatgtccgggatcataaaaacggattaaggttccctctcctattttgccttgttccccataaatatctccagctggggaacaatcgacagctaagaagatatctgggttgaatttagttgttgaaacatgtgcgccacgaagtccgacttcttcttgaacatttgccccagcaataagtgtgttgctaagactttgatcttttaagctttttagcaattcggtcaccataagcacaccatagcgattatcccaagcttttgacataatatgtttttgatttgcagttaaaatggtttcagatttaggaacaatgatatcgccaggagcaatgccaaagctttcagcttcatttttatctgtgaatcctccatcaaaaacaatgtcactaattttgggtaatgttgttccaccgctttgtccacgaagaaagtgaggaggaactgagcctgatataacaggaatagcatcaccagaacgtgtgtagagggtaaagcgttgtgagctgactactaggggattccatcctccaacctcaagtacacgaaatgttccatctggctgaatatgactaaccataaagccgacttcatccatatgggcagcaaccatgactttaggagcattagtctcatgagtatttttaactccaaaaattccaccaagtccgtctgtctcaacttgatcaactaaaggagttatttcttgacgaaggaagttgcggatattgtgttcatagccagcaatcccatcaagctcagttacggttttaattttgttaaataaatctgacataattacctcaattctacaaatactattttagcaccttttaattaaaaataaagaacagaacaggtttcagtcaatataaagactttcaaaaagaatatcaagtactatcggaagactgttatgactgacaaagcctattatagtgaaaactgggttgaatacaacggagataatgtttatcggcttaagctaataaaaaggtagatagaaaagataatacggctaaaaaagtgataaccatagcaattaaagtcaaatttttggggtgattcttattgattaaaaatgaagttgtgcaaagcagtattagcgtcacaatagcaaaaagttctccattttgaagacgaaataaaaaccagtgatcacctaggaagagtagacctagcaaacaatttaaagcaggtactaataatttttctttcatgttttttctttctgtttgaatgattaaccataatggtatcttaagacaatgtcatcctattataccacaaggaataagttgttttttttcataactgttatgtggatttcttccatcaattcctgtgtctaattccggggggtatggtataataacagttatgaaaaataaaaaaatcttatttgggactggccttgctggtgtgggtttactggcagctgctggttataccctaactaaaaaagtaacagattataaacgtcagcaaatcactcagaccttaagagaattttttagtcagatgggtgatattcaggtattttattttaatgaatttgaatctgatattaaaatgaccagtggtggtcttgtcttggaagatggcagaattttcgaattcatttatcgtcaaggtgttcttgattatgtggaggtgagcaaatgattttaccagaatcttatgaagaaatagcagcctatattgatagcactaagaaagttgttttcttttttacagcagattggtgtccagattgtcaatttatatatccagtaatgccatcaattgaaaaagatttctcagattttgtctttgtacgtgttaatcgtgatgactatatagaattagctcagcagtggaatatttttgggattccgagtttcgttgttgtggaaaatggtcaggaactgggtcgtttggttaataagaatcgcaaaacaaaggctgaaattactaaatttctcgctgaaattaactataaataagacagaaaatagcaaaatttaaaggagaataaatgatttttacttataatagagagcatgttggtgataccttaatggttattgttaaggatagtcaaggagctaagctagatgttgatcgtcgcggacaagtagcacgcgtctatctgcaagatagtaaagaaacagttgcttggaatatctttgaagtgtcaagtttaattgttattgagggagcaggtcaaataactttatctgatcaagatattaaaatccttaatgcagaactactgaaagaaggattcgaagactctcttgttaataatattgaacctacatttgttgtggcgcaaattaaagaaataattgatcatccagatagtgaccatttacatatctgtcaagcagaaatcaacgatgggaagacggtccaaatcgtttgtggggcacctaatgcttcagtaggtcttaaaacagttgcagctcttccaggagctatgatgccaaatggtagccttattttcccaggaaaacttcgtggagaagatagctttggaatgttatgtagtgctcgcgagttagctcttccaaatgctcctcaagtcagaggtatcattgaattatctgatcaggtaattgttggagagtctttcgacgccaataaacattggaaaaattagtaaaaatcaacttagcttcagctaagttgatttttagttgtaaacttaagaagttacaatgactttttaagtgtgatgtgttgcaaaaaagcaatatctttataaggagctttgtcagcaacacttagctcgatagcaagcattttgtttagccaaccagtttcagttttaaaatggtttggttgtaatgaatagaaggtacgaataccctgataacgttcaactaataaatttgtattttgttttagttcttctaaggtataaatatttccctggtcaaaactggcacttttaaagtttgcttctcctgttaagagttccatcgcagtggaggtatcattgctaaaaataactgattgtaatattttaccggttatattatgtttgatgagagatagttctccattgggttttagaagtcgagaaaattcgtcaaaataagcaggatgattatgtttgtctatatattcaagaacattatgacaaataatagtatcaaagctttgatcaggcaaatctcttaatgcttcgtaggaacctaggattttataaatattgtcactttgattatcgtaaagcagtttaggattgggttcaatagcagttacattgttttcttttgctagatgttgttcggtgagacaaaaaccagctccaaaatctaaaacgttctgatttttgatatggcttaattgagcaaaagttatttcatattgtatttttccccaaggtttagccagcatttctttataactagttacatttgtcatcttaattctcccagaacaatttcatatattttagcatttttcttccttattttcgaataataatagtgaggaggtaatcaatgtataataaagttattatgattgggcgtctaacagcaaagcctgagatggtaaaaacaccaactgacaagtcagtgacgcgtgcaactgttgctgttaatagacgctttaaaggaagtaatggtgagcgtgaagcagattttattaatgtggttatgtggggtcgtctagcggaaacccttgcgagctatgggacaaagggctctttaatttcaatagatggtgaattgcgtacgcgcaagtacgaaaaggatggtcaaacgcactatatcactgaagtattagcatcatcatttcagttgctagaaagccgtgcccaacgtgctatgcgtgaaaataacgtttctggtgatttgtcagatttagtattggaagaagaggagctccccttttaaataaaatcactctcaaaatatcatttctaaatatactggttgcttttcacagaaagcaacctttttttattgaaaatagaaaggcaaacgattacaataaaggggatagaaagcaggtttaagatggaaaaagtcattatttttgatatggacggcgttattgttgattccgagtacacgtttttagataataagacagaaatgttacgtgaggagggtattgatacggacgtctcgtatcaataccagtacatggggactacttttgaattcatgtggcaagctatgaaagaggagtttggcttaccgaaaacagtaaaagagtatattgctgagatgaacagacgtcgacaagcgattgtggcgcgtgatggtgttaggcccatcaaaggagctcagcgactgattcattggttacaccaacatggctatcgcttagcagttgcgtcctcatctccaatggtagatattaagcgtaatctaaaagagttgggtgtgacagaatgctttgaatacatggttacaggagaagatgtatcgtcttctaaaccagcaccagatgtttttcttagagctgcagagcttttagatgtagaccctaaagtttgtatagttatagaagatacaagaaatgggagtttagctgctaaggcagcaggaatgtattgctttggctttgctaatcctgattatccaccgcaagatttatcaatggcagacaaggttatttcagattatcaagatatctatatttatcttccggagtaaaatggtatcttgaggaggataagcatatgttgatggtgttgttattccaaaggctaggaattattatgattttagcctttttattggtaaataatagttattttagacagttaattgaagagcggtctaaacgtgaaacggtagtccttgtcatcattttcggcttgtttgttattatatctaatataacaggaattgaaataaaaggggatcgaagtttggtcgagcgcccttttctaacaacgatttctcattctgactcacttgctaatacaaggactttagttattacaacggcaagtttggttggtggacctctggttggatcaattgttggttttattggaggagttcatcgcttttttcaaggaagcttttcaggttctttctatattgtcagttcagttctagtcggcattgttagcggaaagattggtgataagcttaaggaaaaccatctctacccttcaacaagccaagttattttaattagtattattgccgaaagtatccagatgctatttgttggcatttttacaggatgggaacttgtcaaaatgattgtcattccaatgatgattttaaatagtttaggttccacacttttccttgcgattttgaaaacttatttgtcaaatgaaagtcagttacgcgcagttcaaacgagagatgttcttgaattgactcgacagactctgccctaccttagacaaggtttgacaccgcaatctgctaggagcgtttgcgaaattataaagaggcatactaactttgatgctgtgggattaacagatcggtcaaacgtattagctcatattggtgttggccatgatcaccatattgcaggacaaccggtcaaaacagacttatctaaaagtgttatttttgatggcgaaccaagaattgcgcaagataaagcggcgatttcttgtccagatcacaactgtcagttaaattctgctattgtagttcctctaaaaataaatgataaaactgtgggtgccttaaaaatgtactttgcaggagataagacaatgtctgaggtggaggaaaacctagtccttggtttagcgcaaatattttcaggacaactggcaatggggataacagaggaacaaaataagttagccagtatggcagagataaaggctttacaagcacaaatcaaccctcatttcttctttaatgccattaacacaattagtgcattaatccgtattgattctgataaagcacgttatgcactgatgcagttaagtactttttttagaacaagtttgcagggtggtcaggatcgtgaggtaacgcttgagcaagaaaaatcacatgtggatgcttatatgaatgttgaaaaattacgtttccctgataaatatcagttatcttatgatattagtgcaccagaaaaaatgaagttaccaccttttggtttacaggtactggtagagaatgcagttcgacatgctttcaaagaacgtaagacggacaaccatatattggttcaaataaagccagatggtcattattattgtgtttctgttagtgacaatggacaaggaatctcagatactatcattgataaattaggtcaagaaacagttgcagagagtaagggtacaggtactgctctagttaatctaaataacaggctgaatttattatatggtagtgtaagttgccttcatttttcgagcgacaagaatggtacaaaagtttggtatcgaatacctaatagaataagggaggatgagcatgaaaattttaattcttgatgatgaaatgtttgccagacaagaattatcgtttttagttgaacatagccaggaggttgacaaccctgagatttttcaggctgaggatatcagtgaagccgaaaaaatcttatttagacagcaaattgatttaatttttttagatatttcgcttagtgaagaaaatggctttactttggctaatcagttgagccaacttgcacatcccccacttgttgtttttgcgacagcttatgataactacgctgtgaaagcttttgaaagtaacgctgttgattatatcatgaaaccgtttgaacaacagcgcgttgatatggctctatcaaaagtgaagaaattgagccaactcaccactgcttcagatgtagagcaagcaatacctaaaaaagccagtgttgaattgttaaccttgacattatcagatcgcagtgttgttgttaaaatgcaagatattgttgcagctagtgttgaagatggcgaattaactgttagtacagttcagaaaacttacactattcggaagacactcaattggtttaagtcacgcgctgtagcaccatattttctccagattcatcgaaacacagtgattaatctagagatgattgaggaaattcaaccttggtttaatcatactttgttactaattatgtctaatggagagaaatttccagtaggtcgatcgtatttaaaagacctaaatgagcatttaaccatgtaaaagtgcttttgcgaacttccctttgttgtttagaagcttgaatttgcaattcggcttctttttttggtaactgagactaaaaatgaaaacgttttatttgttttgaagtacaatatagctatcaataaaacaagttaaaacattgtaataaaaggaaggggtagtgactatgaaacacaccagtaaagaaaccaaaacaaaagaagctccaatgtttattcaaatgtcaatatatgcagctattctattagtttcacaaatgatttcaatgttattaccgaaatcactaccaatcccaacgacggttattggtttggtgctaatgtatgtattgctaactgctaaaattatcaaggtagagtgggttgactcttttggggctttgatgataagcatgattggttttatgtttgtcccctcaggaatatcagtagcagcgaatcttgatatcctaaaagctgaaggcttgcaactagttgctgttattacaatctcaactgttgttatgttggtagtggtagcatatgttgcacgattaatacttgctatcagagaactcagtgtcacagatttatttaaaaagatattacctaaccactatagtaagaaagtagaggaaaaataatatggaactcttaaaaacacccatctttggtatttgcttttctttaatactctatacgataggagaacatttatttaagaagagtaaaggtttcttccttttgcagcctcttttctttgcaatggttagtggtattgtcattctttggcttatgtcaaaaggtttaggaaccgatgttaagacattttatacacaagcttataaaccaggtggtgatttaatattttggtttttaaatccagcgacaattgcttttgcagttcctctctataagaaaaatgacgttgttaaaaaatattgggtagaaattctcagcagtttagtaatcggtatgattgtttcccttatacttatcgtcgctatttctaaaatggttgggcttagtcaagtcggaattgcttcaatgttgccacaagcagcaacaacagcaattgctcttccaataacagcagcaattggagggaacacagctgtgacagcaatggcgtgtatcttaaatgcagttattatttatgcattaggtaaaaaattagtgtcatttttccatttgaatgatagtaagattggtgcaggattaggtctagggacctctggtcatacagtcggagcagcctttgcattggaattgggagaactgcaaggtgcgatggcagctatagctgtggtggttatcggtttggtagttgatttggttattcctatctttagtcatttgattggtttgctataactaatagcgtggttaaggctgaatttattcagcctttttatgatgtctattaaaatacattggattaacatggtttatgagctagtgtctagaattgtgttttacctaactttaagttattaatgataaaataacaaattttctaattaaccagttaagtaattgttctcctacttttttcttgttataatgaaaaaagttgtcaaaaatattatttatcaattaaaaaaggaggtttaatagtgactaaatatttgaagtacatctcttttgttgctttgtttctggcgagtatctttttagtagcttgtcaaaatcaaaattcacaaaccaaggagcgaacgcgaaaacaacgacccaaagatgaattggttgtttctatgggggcaaagcttcctcatgaattcgatccaaaggaccgttatggaatccataatgaaggtaatattactcatagcaccctattgaaacgttctcctgaactagatataaaaggagagcttgctaaaaaatataaaatctctaaggatggcttaacgtggtcgttcgacttaaatgatgattttaaattctccaatggtgagcctgttactgctgacgatgttaagtttacttatgatatgttgaaagcagatggaaaagcttgggatttgacctttattaagaatgttgaagtagttgggaaaaaccaggtaaatattcatttgactgaggcgcattcgacatttacagcacagttgacagaaatcccaatcgtccctaaaaaacattacaatgataagtataagagcaatcctatcggttcaggaccttacatggtgaaagaatataaggctggagaacaagcaatcttcgttcgaaatccctattggcacggtaaaaagccttattttaaaaagtggacttgggtattacttgatgaaaatacagcactagctgctttagaatctggtgatgttgacatgatttacgcaacgccagagcttgctagcaagaaagtcaaaggaacacgtcttctagatattgcttcaaacgacgttcgcggactgtcattgccttatgtgaagaaaggtgttgtgaaaaattcaccagacggttatccagtaggaaatgatgtcactagtgatccagcaatcagaaaagccttgactattggtttaaatagacaaaaagttctggatactgttttaaatggttatggtaaaccagcttattcaattattgatagaacaccattctggaatccaaaaacagcaattaaagataataaagtagctaaagctaagcaacttttgacaaaagctggatggaaagaacaagcagacggtagccgtaaaaaaggaaatcttaaatcggaatttgacctttactaccctactaatgatcaattacgagcaaacttagccgttgaagtagcggagcaagctaaagccttaggtattactattaaactcaaggctagtaactgggatgaaatggcaactaagtcacatgattcagccttactttatgcgggaggacgtcatcatgcgcagcaattttatgaatcacattacccaagtttagctggtaaaggttggaccaatattactttttataacaatcctactgtgactaagtaccttgacaaagcaatgacatctcctgaccttgataaagctaacaaatattggaagttagctcagtgggatggcaaaacaggtgcttccactcttggagatttaccaaatgtatggttggtgagtcttaaccatacttatattggtgataaacgtatcaatgtaggtaaacaaggtgtccatagtcatggtcatgattggtcattattgactaacattgctgaatggacttgggatgaatctgctaagtaactaatttagttaatgtaggctactttaagtttggagtcagagaaaacaatgtacaccttatggtgtgaatggtttcctcgactccttttttaacaattaaggagatttatctgtgaaacatattaccactgtagttatctggaagatacttaggtgtttgtcactcgtttttggagtatcaattttgacctttattttactaaaacaatcaccggttgatccagtcatggcaagtgtcaattatgacacgtcactaacccctgttcagtacaaagcgattgctcaccactatggtttggataagccagctccggtccagtattttatttggttaaaaaattttatacagggacatttagggacttcactagtttatcggcaacctgttattgatattattagatcacgggcaggtgcctctttcatacttatgggactctcctgggtcttatcgggtcttattggatttatcttaggaactttatcagctttccatcaagggaaattgcttgatcgaattgtaaggtggttttcttaccttcagatatcagtaccaactttttggattgggctcatttttttattaatcttttctgtccagctggggtggttcccgattggtatttcttccccgataggtactttgagtcaagatattacgttagctgatcgtattaagcaccttattttacctgttttcacgctaagtattctaggcattgccaatgtaactcttcatactagaactaaaatgatgtcggtactttctagtgaatatgtcttatttgccagagcgcgtggggaaacggaatggcaaatttttaaaaatcattgtcttagaaatgctatcgtaccagctattacactgcatttttcctattttggagaattgtttggaggatccgttcttgctgagcaagttttctcatatccaggactagggtctaccctaactgaagcaggacttaaaagtgatacaccgctacttctagctattgtgatgatagggacattatttgtttttgcgggcaatcttattgcggatattttaaacagcataatcaatccacagttaaggagaaaagtatgatattgagacgtcgaactattgttttatggcaactgggtatcgccatttctctcattcttagtattctagccttaaatctttatttccatagtactcccttgcaaaccaatgcagctttacggaaccttgctccttcattaaaccatctttttgggacagatggtttaggtagggatatgtttgtcagaacgattaaaggactttatttctctctacaagtctgcttattaggtgcccttatgggggtcattctggcgacagtttttggagtgcttgcaggtttaggaaatagcattattgataaaataatagcatggttagttgatttgtttattggtatgcctcatttgatttttatgattctcatttcttttgttgttgggaaaggtgctcaaggggtcatcattgcaacggctgttacacattggccttctttagcaaggcttatccgcaatgaagtctatcatctaaagaataaagaatttgtccaactttctaaaagtatgggaaaaacgccttattatattgtgaggcatcatatcctgcctttgattgcttctcaaattttcattggttttatcctcttatttccacatgtcatcctacatgaagcatcaatgactttcttaggatttgggctctctgccgaacaaccttcggttggtatcattctgtcagaggcagctaagcatatctctcttggaaattggtggttggttatctttccaggactttatcttattttggttgtcaatgcatttgatactatcggagaatctttaaagaaactcttttaccctcaaactgatcatttttaggaggtagagatatgacagaaacattattaagcattaaagacctctccatcaccttcactcaatacggaagatttttaaaaccatttcaatcaacaccgatacaagcgctgaatttagaaattaaaaaaggtgagttattagctattataggtgctagtggttcagggaagagtttattagcacatgctattatggatattcttcctaaaaatgcatctgtaacaggagatatgatttatcgtggtcaatcactaaattctaaacgcattaaacagttgcgaggaaaagatattacgttgattccacaatcagttaattatttagatccatctacgaaagtcaaacatcaggtgcgcttaggtatctcagaaaattcaaaggctactcaagaaggattgtttcaacagtttggtttaaaagaaagtgatggtgacttgtatcctttccaactttctggcggaatgctccgacgtgttttgtttacaacgtgtattagtgataaggtttctttgattattgcggatgagcccacccctggattacatccagatgctctgcaaatggttttagaccaactacgctcctttgcagataaaggaataagcgttatatttatcactcatgatattgtagcagctagtcaaattgctgatcgtattactatttttaaagagggaaaagctattgaaacagctccagctagtttctttagcggaaatggagagcagttacaaacagaatttgctagaagtttatggcgctctctcccacagcaagaatttttgaaaggagttactcatgaccttagaggctaaaaagcttggcttttatcataaaaaagatcaatggctttttaaggagattaatttagaggtagcacctggtcaagttttaggtatatttggacaaagtggttgtggaaaaactagtttatccagggtgcttgcaggttttttacatcctaaatctggtgaagtattagttgatggcagtaatttgcctagcaaagcatttagacctgtacaacttattcaacaacatcctgaaaaaacgatgaatcctttatggcctatgaaaaaaagtttggaagaagcctattacccaagtcgagatttactagatgcttttggaattcaagaaaaatggctaaatcgtcgacctagtgaactctcgggaggagaattacaacgcttttcgattgtgcgttcattacatccagagactaaataccttattgcagatgaaatgactactatgttggatagcattacacaagctagtgtatggaaaagcctgttggagattgtaaaggatagaaatttaggtctcatcgttattagtcatgatttcgctatgttagagaaactttgtaaccaatgctatatgattgaagagaatcgtatcgtatctttcaatggagattaaaaaactcacctactatatcaattagtaggtgttttttattaagagagtattgagggtgactgatctactcatgactctaacattttggtaacgttggtgagaaattctaatgttttgggtattattgactaatttattttataatttatagattttttaaaaagataagctaaggatttgcatagggatatgtaatcgtttacaattatgttgtaagctagtcttatttaagtttctgccttggagtcacagactctccgttaaatagataaggataaacagatggaacaatttaaacatgatgccaaagccttgttagaggcaattgggggtaaagaaaatattagtgcagtgacacattgtgctacacgcatgcgatttgttttgaatgacagtagtaaagctaaggtaaaggtaattgaggagttaccatcagtcaagggtacctttaccaatgctgggcaatttcaagtcattattggtaatgatgtccctattttttataatgcttttgtagccgtttctggtattgagggtgtgtctaaagaggcggcaaaatcggctgcccaaaaaaatcaaaaccctttacagcgtgtgttgacaatgctggctgaaatatttacaccgattattccagccattattgttggtggtctgatccttggttttcgtaatattttagatgccgttccatttgaatttttaggtcaaaaagttgttgatggtgtcaggcaagtagactcttctgggcatccaatttggaatactctagtagatgtttcaacgttttggagcggagtagactcttttttatggttaccaggtgaagctatatttcatttcttaccagttggtattgtatggtctgtgactcgtaagatggggactactcaaatcctcggtattgttctaggtatctgtctagtgtcgccacaattacttaatgcttattctgtagctagtacttcagcagcagacattgctaaaaattggtcttggaattttggttactttacagtacaaaaaattggttatcaagctcaagttattccagctctgttagctggtttgagcctgtcttacttagaaatcttctggagaaaacatattcctgaagttgtttcaatgatttttgtgccatttctatccttagttccagctattatcttggctcatactgtccttggacctattggttggacactaggtaaatggatttctgctatcgttcttattggattgactggtcctgtaaaatggctctttggtgctatttttggtgccctgtatgccccatttgttattactggtttgcaccacatgacaaatgctatcgatactcaactcatagcagatacaaaaacacatacaactggcctttggccgatgattgctctttcaaatattgctcagggttcagctgtactagcttattattttatgcatcgtcatgatgaaaaagaggctcaaatatcacttccagctgctatctcagcctaccttggtgttacagagccggcgctttttggtgtaaacgttaaatacatttatccatttgttgctggtatgattggttcaagtgtggcaggtcttttggcgacaacttttaatgtccaagctaactctattggtgtaggcggtcttccaggcttcctgtcaattaacgttaaatatatgggatatttctttatctgtatggcagtggctatctttattcctttatttttgacactattctttaaaaaatcaggtattttgacaaaaactgaagaggaaaaattagtacctgatgctgtcattgcttcaacaacagaaacaaaatcagcaaaagaaaaagctgtcgtatcaggtacaaagcttagtgtagtaagccctttatcaggtttagctaaaccactggatcaagctagtgatcctgtcttttcacaaggaattatggggaagggagtggttatcgatccaagtgatggagaactagtttcaccggtcgatgcgacagtttcagttcttttccctacgaaacatgctattggattgttaacatcagagggggttgagtttcttattcatattggtatggatactgttaatttagaaggaaaagggtttacctctcatgttgctcaaggtgacactgtaaaagtaggagataaactcattactttcgatattccaatgataaaagaagaaggatacattgtggaaactcctattctgattactaatcaacaagaattccgaccagaagaattgatagatttacccaaacagataaaacgtggacaagcattaatggttgccaagaaaatttaaaagtaattaggtattctttttaaaaaagagcactcttataaaatgagaggtaatttgaggaattgtttgaggggcttaatacattagctccttgaattattttgaacataagaaaaaactcataggaacaaatatcactgtaaaaatgttatatttttgatgatagttgatgttatagttagactgctaaatacagcagcattttgggaaaggagtagaatatgacgattgataaacgtaaagttgtctatcaaatttatccaaaatcatacaaagacacaactggtaatggggttggtgatcttcgtggtattatcgaaaaattaccctatttagcagaacttggtattgatatggtttggctcaacccattttatccaagtccacaacgagataatggatatgatatctctgattatacagctattaaccctgattttggaacgatggacgattttgaagaaatgattgaggtgggacgtcaataccgtatagattttatgcttgatatggtgcttaatcattgttcaatagaacatgagtggtttaaaaaagcacttgcaggagatcgctactatcaagatttctttatcttacgtgataatccaacagattgggtatctaaatttggtggaaatgcttgggcaccatttggtgatacagggaagtattatcttcatctttttgatatcactcaagctgaccttaattggcgcaatgccgatgttcgcaaggaactttttaaagttgtcaatttttggcgtgataaaggggttaaaggttttcgatttgatgtgattaatttaattgggaaagatgagatacttgagaactgcccaattaatgatggaaaaccagcttatactgatcgtccaataacacatgattatctcaagatgttgaataatgctagttttggacaagatgattccttcatgacagttggtgaaatgtcttcaacgacaattgcaaattgcattctttacactgcaccagaacgtgaagagttatccatggcttttaattttcaccacctcaaagtagattataaagatgggcaaaagtggaccattatggcttttgattttcctgcattacgtgaccttttccatagttggggcgaagggatgagcgaaggaaatggttggaatgctttattctataataatcatgaccaaccgcgagcattaaatcgttttgtagacgtgaaacgttttcgaaatgaaggagcaaccatgttagcagcatctatccacttatcgcgtggtactccttatatatatatgggtgaagaaatcggaatgcttgatcccgattacagttctatggatgattatgtggatattgagagtttgaatgcctaccaaataatgcttgatgaaggcaagtcacaagaagaggcatttagcattattcgagcgaaatctcgagacaattctcgagtaccaatgcaatgggatgatagtacgaatgcaggtttttctgaaggcgctccatggttgaaagtaggaaaatcatataaagaaatcaatgtcgcaaaggagaaaacagggctgatatttactttctatcaagagttgataaggctacgtaaacaactgccaataatagctgacgggaattataaagcagctttcaaagataatgaaaaagtatatgcttttgaacgccatcttgataaggaaaaacttcttgttttaaataatttctttgctgagaaagttaagataaaattaccggagaattatctccaaggacaagttcttctatcaaattataaggatgttactcttgatgaaacggttactttgcaaccttatcaaactttagctatcttagtgtcataacattttaaaaacctttacttattcaattaagtaaaggtttttaaagtgctgcttgtggaaaggaatcttgctctagattttgcaatttctttcttttttctttactctataacaatagcccaaattcattcaattgatagtagtgccagattgggctcaaatgacctagaaaaatgtaaacggttactataaaataaaaatagaaaggaaaacaaatggttgataataagactgttgtgataatgttggtatttttagctcggaaaaatctttccttgtatgagttaacagtgcaaacaaagttttcaataaaagttatcatagagcaaattaactatctcaatagttttttagcaaaaaatcacctaccagctattgctcactctgctggacgttatcagttattaggagatgaaaaagagcatgataaaattgtctccttattagaagctgagcaattttacctaacccaggaagaaagggtatgtctgatttacctttatagcttttgccgaagagagtttgtctccaatgtgcattatcaagattttttgaaagtaagtaagaatactactttatcagatatcaagatgctacgttctaaattagcaaaaagaggtatctcactcacttatacaagagcaaagggatatagtctagtaggagatgagatggataagcatcaagttgcttttcagatgataactcaactactagaatctcccattggtttttggtctttgaattatatcttgtcttcttggaaattcgctctctcatatgagaagttagaaaagacggtagaatatttctatgaatcttttcaactttctccaatacaagataggcttgagaaatctttatattttatcattttaatactgtgtcgttatcaaaggtcagtagatcgtgttttgcagggttctcctattgtttctgaacaattaaaagagttaacgactattattgtgactaatttaagtcaggatatttccttatctaaaccattagatcagaaagaaaaagattatattaccttgatcttatctggctgttttgaaggtgagggaactaaagatgatgatttctttgaagcattggcaaaagcaatcgttgatgagatggaaactgtttcacttcttaatttttccaataaagaagagttattacaaggtctgaagcgtcatattattccagcttatttccgattgaaatatggtttaactggcgatagtggttatacacaaaatattaaagagcattacagtgatttatttctattggttaaaaaggcactacgtcctttggaagagcaagtaggattaatacccgatagtgaaatttcttacttcgtgattcactttggaggctatcttagacaatcaggtggtacacaatcaatgtcttataaagctttgatactctgtccaaacggcgttagttcatccttagtgattaaggaaaaattgcgtggattatttcctcaaattcattttcatcgtgtctctaaaattgagcagctgaaactgattgacaatcaaacttacgatatggtcttttctactatatttgtagaaacaaaaaaacctaattatctagtttcgctgatgatgacagcagagcaagtacaacagctcaaagaactggttatttcagattttcccaaggcttgccttgacgatttccaacttgatcaattaatagcaactataaaaaaatacgctcatgttcattgtgaagaggaattaaaattggctttgaggacaatggtaaaacaagatatacttagaaaggatgtgaggcccttgttgcaccaacttataacagaggaaacttatcagacaagttctgaacaaatgaattggaaagaggcaattcgtttagcggcaaaacccttgttagcttctggaaaaattacggaaagttacccagaagctatgattgaaaaagtcgaagagtttggtccttttatcaatcttggtaaaggtattgctattccacatgccagaccagaagatggggtaaactctgtcggtatgtcaatgcttgttttggaacagccacgccgtacgcatgaaaactttctcttcatccttttgtgcccggacatcaattttgaaaagattcctttttaaatcaatgatctgcttagcctctttctccaaataattggactaaataatcttccaaatggacagaaatataccgttgtttgcgacgataactgaggtcttttttaggaaataccatcactttgagaaaatataagcacatttttcggataagatttaggttaaatgcggctcttttatccaatgtctgatgatgatcttcatgataaacaacgtccaataaccagtgcatactctctatctgccaatgacctcgtacacaattggcaaatgtgaggacatccggcttaaagctaaagataaaataacgattctcttgactcagctgaccatccttatcaatcgtgttacgagtcatcccaataccacgtaacttatgccatttgggatggttttgacacaaccatttgatatcggaagacacccagtattctctaacttcaatctgtcccctagatttttcaacagtctgataatactgcgcattttcttggagttcttccaataagttgacatcactaaaataaagagcaatatcatcataaagtgtttcttgatttcctttgacggctaagcaatagtctgctttaccttttataatcgtatcaacgatagccgtctgcgtgcccattgcgtctatcgttacaatgcttttacggatatcaattgtccgcaataactgaggaatggcaacaatttcattacttttctcctcaaccgctacctgtcccaaactaagatgatgacccccatcataagccgttacaatatgaacaggcttctgatttttacctcgattgcctcgaatcgttttaccgtccactgaaatcagttgatgaacggcatctaagcttgtcaatgattgctcaaattgaactttaagctcttttaaacggtctgaattaacaagactaatcacacgctctaaggtatcatgagacggacaaccttcactcaaatcaacgtaggtcgcaaacaatggttcattcatttcaataaaatcttccatctccttccaggtttcaatgccagctaactgacaaacaaagacaagaaatagaatggttgataaggggtagcgaattttccaagattgacgactatccaattcaactgcgcaatcatcaatagaaataataaaatcaatcatcgtagtcacctcatctatagtgtactactttgattgattttgtcattatgaatctagttttctgaaaacaaaagtttcttcatgcgtttggcgtgtggaacagcctatttatttattggatgaccccaaacaggaaatttatctcttattatgcatagcagctattgataatgaaacgcatttgaaagctctatcgcatttgacaacaatacttcgtgataataataatgttaaagctttgttagcttcacgtaggtatcaagatattgaaatgattataaaacaggaggattaaagatgttaagaattggaacagcatgtggatcaggtttaggttcaagttttatggtacaaatgaatattgagtctattttgaaggatttgggggtttctgatgttgaagttgaacattatgatttaggtggagcagatccaagtgcagcagatgtttggattgttggtcgtgatttggaggattcagctggtcacctgggggatgttcgtattttaaacagtatcattgatatggatgaattgagagaattagtgacaggtatttgccaagaaaaaggcttaatctaggaggttgatgccatgaaaggtctattggattttttagttaatattgccagcacgccagctattttagtcgccttgatagccattatcggtttagtactgcagaaaaaaggcgttcctgatattgtaaaaggtggaataaaaacatttgttggcttcttagtggtttctggaggtacagggatagtccaaaattccttgaatccatttggaaaaatgtttgaacatgcttttcatttggtgggggtagttcctaataatgaagccattgtagcagtagctcttacgaagtatggctcagcaactgctttgattatgttagcgggaatgatttttaatattttaattgctcgttttacaaaatttaaatatatttttctgacaggacatcatacattgtatatggcttgtatgattgctgttatttttgccgtagcaggctttacttcgttctcgctcatcctttttggaggtctagcgttagggattattatgagcgtatctcctgcatttgtgcaaaaatacatgattcaactgacaggtaatgataaggtggcacttgggcactttggttctttaggctattggttgagtggatttattggtggaattgttggagataaatcaaaatcaacagaagatattaaatttccaaagagtttatcatttttacgtgacagtaccgtaagtattactatctcaatggcaattatttaccttatcgttgcagtgtttgctggtgaggcttatattgcaaaagaaataagtaacggtgtcaatggtcttgtttatgccctccaactagctgggcaatttgcggcaggtgtattcgttattttagcaggtgtacgccttatcctaggtgaaattgtaccagcctttaagggaatctcagaaaaattggttccaaattcaaaaccagccttggattgtccaattgtttacccttatgcacctaatgcagtattgattggttttatctcaagttttgttggtggattggttagtatgatagtcatgattgtgactggcactactgtcattttaccaggggtcgttcctcatttcttctgtggggcaacggcaggtgttatcggtaatgcttctggtggtgtgagaggagcgactattggtgcatttgttcaaggtatcctcatcagtttcttgccgattttcttgatgcctgtactaggtggacttggtttcaaagggtcaacattctcagatgctgattttggtttgaccggtatcattcttggcgctcttaatcatgtcggcggtgcgatagctattgttattggtattgtagttatcttaattggactttttggcatttcatttgttggaaaatcaacccataaggaaggttaataatgacatcaccagaagaaagatattcatctctaagacgatttgcaacggagattcgtttaaatactctagaaacgctaaaccatttaggattcggtcactatgggggtagtttatcaattgttgaggctttggctgttctgtatggtgatattatggatataaatcctgaaaaattcaaagaaagtgatcgggattatatggtcttatcaaaaggacatgctggtccagccttgtatagtacactctatttaaaaggtttttttgataaaacattccttcattcgctcaatacaaacggtaccaaactaccttcgcatcctgaccgcaatttaactcctggtatagatgtaacgacaggctcgttaggtcaaggcattagtattgcaacgggaattgcttatgctcaaaagattgagaattcaagctattatacttatactattgtaggtgatggtgaattaaatgaaggacaatgttgggaggctatacaatttgctgcgcatcatcaactgcaccatttaattgtttttgtagatgataataaaaaacaattagatggtttgacagctgatatttgtaatcctggagactttgttgctaaatttgaagcttttggatttgatgcagtacgtgtaaaaggagatgacattgaggcaattgacaaagctattaaaacttttcaagattcaaatagtgtcagaccaaaatgtattgttttagatagcatcaagggacaaggtgtgaaagagttggaggagttagcttctaatcatcatttacgaccagatttacaacaaaaaacaatgttagagcgagcgttgataagcttgagagaaagtttggaggtggtagaatgagatgttcaaccaaagaaatgaggcttgtctatcgtgatttcctccttcaagctaatcaagaaaataaacaaattaccgttttagaagccgatttgtcgagttcaatgtcaacaaatgcactggcatcagaatttggaaaacgttatattaatctaggtattatggaggctgagatggtaggccttgcagcagggctcgccattaaaggttacaagccataccttcatacttttggtcctttcgcgtcaaggcgtgtctttgatcaagtattcttatcgttaggttactcacaattatcagctacgattattggctcagatgcaggaattagcgcagaaatgaatggcggaactcatatgccttttgaagagttaggtctactaaggttaattcccaaagcgactatttttgaggttagtgatgatattcagtttgaagcaattttaaaacaaacattaagtattgatggcctaaaatacattagaactattcgtaaggcccccactgcagtttatgagggacgcgaagatttttcaaagggttttatacaattacgccagggaaaagatattactcttgtagcaagtggtattatggtttctagagcgatagaagcagccgactacctcaaagaactagggattgaggcctcagttatcgacctttttaaaattaagccccttccagaagaactgaaaccattactgatagatcaatccattgtaactattgagaatcataaccgtattggcggtatcggaagtgcattatgcgaatggcttagtatggagaaagacactactgttagtcgtatgggtattgatgagcgatttggtcaggtaggtcagatggaatatttattagaggagtatggactcgctgttaaagatatagtacagcattgcaaatcaatttataaatcataacaaaaaggcaacattggagttgcctttttgttattttctgaaatttttaagttttgtataagtatcttgtggtattttatccttactaaaaataaaggggtggtcgttatgcgagcttggaaaggtattgttttaattttatctagcatagtggtgacactagtagcatggcaaaatgcaggattaagtgaatttgttgtaccaggattagctttgacaagtttatcgctaacattcctcttatcaaccaaatttaggatacttgaaagttactttcaaggtattgaaaatatgtatttttaccacaaggtaatggctgtattttcaatgattttgcttctattgcacaaaattggtcttggacaaggcggacatggaagtgagtttgcaaagactattggcagtgcgggattatatctttttctaagtattgtttttgtagcttatttcggaaattttttaaagtatgaaatttggcgttttattcatcgctttgtttatttagcttatattttgggattggtacatacttttatgattttaggagataggatactaggaaatactttactcagtttaatcgtattaggttatgctgtcattggggttatatctggattttatattattttcctatattctagaatgcgttttcgtcgtgtagggtacgttcaaaaggttactcatcttaaccatgatacaactgagattgaaatagcaatgaagcgtccttatcgatatgactatggacaatttactttttttaaaatttatcaagctggctttgaatcagcagctcatcctttctcgatatcaggtggtcatgatagagtgatatttttaactgttaaagcttcaggagattatacgaaatccatttacaaacagctaaaagttgggacaaaaatagccttagatagagcttatggtcatatgttatttgataaagacaagaaagaacaggtttggattgcaggaggtatcggcatcactcccttcatttcatttattagagaaaatagtattttgactaagagagttgacttcttttataccttttcaaatcaagacaatttgatttatcaagatatgttagaatcctatgctaaagccaatcctaattttaaacttcacttaaataatagtagcctcaaaggaagacttgattttagtcagtctgtttttgaaggacaaccaacaatatttatgtgtgggccaactagtatgacatctacttatgctaaggtctttcggcaaaaagatgcaaagtctcgtttagtctatgaaggattttcctttagagacagttggttatccatatttctattaaaaacttttgacaaagtttattctaatttgataaaataagagggtctataagacaaaccaactttttcttggttttaggagtgccaatcctaagactcggatgaagcaataaaaggagaatatattatggcaatctcaaaagagaaaaaaaatgaaatcattgctcaatatgcacgacacgaaggtgatacaggatcagttgaagttcaagtagcagttcttacttgggaaatcaaccaccttaacgaccacatcaaacaacacaaaaaagaccacgctacttaccgtggattgatgaaaaaaattggtcaccgtcgtaacttattagcatacctacgtcgtacagatgttaaccgttaccgtgaattgattcaatcacttggacttcgtcgttaatagacaacagagtcaagtaaaaacactagaaaattttctagtgttttttgttttaaacgcactatgaacgtaagtactttgaggaggccagcagtaagaaagtgttttaacctatgaagagggttattaagcaagctaagattaaccctagaaatttattttaatcattgtaacaaggtctgattgctagtattaataatcagactttttacgtttacattaatgaatgataatacagcttcctccacggattttcgctactcaattttatagaattatgttagaataaagcttatacgtggttttatgcaaagttgagtttagaacagctagattgaactttgtaggaaacgcgtaaacaaaaaaatatggagaataatatgtcaaaacaagtctttgaaatgatttttgctggaaaaaaattagttgttgaaactggccaagtggctaaacaagcaaatggatcagttgtcgttcgttatggagattctactgtactcacagcagcagttatgtctaagaaaatgtcaacaggtgattttttcccacttcaagtcaattacgaagaaaaaatgtatgctgctgggaaatttccgggtggctttaacaaacgtgaagggcgtccaagtacggatgctaccttaacagcacgtcttattgatagaccaatccgtccgatgtttgctgagggatttcgtaacgaagtacaggtcatcaatactgttctttcatttgatgaaaatgctagcgcaccaatggctgctatgtttggttcatcattagcattatcgatttccgatattcctttcaatgggccaattgctggagttcaagttgcttatgttgatggtaattttattattaatccgacagcacaagaacaagaggcttctgcgttagaattaacggttgcaggtactaaagaagcgattaacatggttgaatctggagcgaaagaactttcagaagaaatcatgctagaggctcttcttaaaggacatgaggctgtctgtgaattaatcgcctttcaagaagagattgttactgctattggtaaagaaaaagccgaggtagaacttcttcaagttgatccagaacttcaagcagaaattattgctactcataacatagctttacaggctgcagtacaagttgaagagaaaaaggctagagaagcagctacagaagcagttaaagaagtagttataggtgaatatgaggcacgttacgctgaacatgaagaatatgatcgcattatgcgtgatgttgctgaaattttagaacaaatggaacatgcagaagttcgtcgcctcattacagaagataagattcgtcctgatggacgtcgtgtggatgagattcgtccattagacgcagagattgattttttaccacaagttcatggatcaggtctctttacacgaggacaaacccaagcattatcagtattaacgttagcacctatgggtgaagcacaaatcattgatgggctaacaccagagtataagaaacgctttatgcaccactataacttcccacaatattcagttggtgagacgggacgttatggagctgcagggcgtcgtgaaattggtcacggtgctttaggagagcgtgcattagaacaagtccttccaagattggaggagtttccgtatgctatccgactagttgcagaagttttagaatcaaacggttcatcatctcaggcttctatatgtgctggaacgcttgctcttatggcaggtggtgtgcctataaaagctccagttgctggtattgccatggggctcatatcagatggaacaaactatacagtcctcactgatattcaaggattagaagaccattttggcgatatggactttaaagttgcgggtacacgtgaagggattacagcacttcaaatggatattaaaattgaaggtattacccctcaaattttggaagaagctcttgcgcaagctaaaaaagcacgctttgaaattcttgatgtccttcatggagctatcgcagagccacgtccacaattagcaccaacggcacctaagattgatatgataaaaatcgatgttgataagattaaagttgtcatcggtaaaggtggcgaaactatcgataaaatcatcgctgaaacaggtgttaagattgatattgatgaagaaggaaatgtatctatcttctctagtgatcaggctgctattgatcgtacgaaagacattattgcaagtttagtacgtgaagcaaaagtgggagaagtttaccatgctaaagtagttcgtatcgagaaattcggtgcctttgtcaacctctttgataaaacagatgcattggtacatatttcagaaattgcatggacacgtacagcaaatgtagctgatgttcttgaaattggtgaagaagttgatgtgaaagtcatcaaaattgatgataaagggcgagttgatgcttctatgaaagcattgttaccacgtcctccaaaagctgacaatcctaaaaaggaatcttaatatgacaagtacaaacgagttagacattagattgcgtgcttttatcaatgcaccggataattttttagatagtataggtcttgtgaatgccttgcaccactctacggtttgggcaagcaaggaaccctatgctattcaagtagatggtcaagaagttgttcctgtttttacggatattactgaccttaatcatttcaaagaggagcaagaaagtgctcgagatatgttttgggagagtcgtcgtagtttagacgttcttgatgaagctatttcacatggcttagcaggattggtctataatttaaaaaaagaaggcgattttgggaactcgactattttctactgtgaagatatggtgcaatttatgaataattacaccacaatcttaaatcagttgttaaatgaagataacattgttgccgatatcatggataaaacctacttggtacctgcctttgtccatccacgtgaagaaggtagttttgaccgtcttttccctacaatgtctacccccgaaggaaaaagttatgttccagtattctcaaaccttttaagttttgaaaaatggtataaccataatgattttggtggtgcttttaggaaagcacaaggagtaattttagcctggacgattgacgatatttataaaccgcgtaatggagaaaatgagattgatgatacctttggagtagccatcaatccatttgatgaacaacaagttttagttgattggtctgatgtagaaaacgattgaggataactatggggtggtggaaagaaagtatagctattgtcaaagaacaagatccagctgctcgtagttctctagaagttattttaacttatccaggaataaaagctcttgcagctcataggctatctcattttttatggaatcataattttaaattgttagcacgtatgcacagtcaattttggcgtttctggacacaaattgaaattcatcccggagcgacgatttcggaaggggtttttattgaccacggttcaggattggtcattggagaaactgccattgtagagaaaggtgctatgctataccatggggttacattgggtggcacaggtaaagacaaaggcaaacgacacccaaccatacgtaaaggagcgctaatttcagcacattctcaaatcattggtccaattgaggttggagaaaatgctaaagtcggtgctgcagcagttgtccttgcagatgtgccagcagacgtaacagtagttggtgttccagctaaagttgtccgtgtccatggtcaaaaggatgatcttcaaatccgaagtattgaacatgatcgagaagaaagttattattcgtccaaactttaggaggtatttgtgaaggattatgtaacaactcaaatattatcaatcttaggtatactagcagcagcttgtttaagctatttaaagtttgcacaaggtaaccctctcttaggaattatttgggctgcttttgttttaatgtatgttgttcgtttgtataaagcttatcaaaaacagaaaaaggaaaaaccatgataaaaatttacgacactatgactcgcagtttacaagattttatacctctcaatgaaggtaaagtcaacatgtacgtctgtgggccaacagtttataactatatacacatcgggaatgcccgcagtgtagtagcttttgatactattcgtcgttattttgagtattgtggttaccaagtcaattatatttctaactttactgatgttgatgataaaattataaaaggtgcagctgaagcaggtatggatacaaaatccttttcagataagtttatttcagcatttatggaagatgttgctgcattaggtgtcaaacctgctacaaaaaatcctcgagttattgactatatggatgagattattgattttgttaaagttttagttgataaggaatttgcctatgaagctaatggagatgtttattttagagtaagtaaatcacatcattatgcaaaattagccaataaaactttggaagatttagagattggtgcaagtggtcgtgttgatggtgaaggagagattaaagagaatcctttagattttgcactttggaaatcagctaaatctggggaagtctcatgggaaagtccttgggggaaagggcgcccagggtggcatattgaatgttctgttatggcaactgagatccttggtgatactattgatatccatggtggaggagctgatttagaatttccacatcacacgaatgagattgcacaatctgaagctaaaacaggtaagacctttgcaaattactggatgcataatggttttgttaacgttgataacgagaaaatgtctaaatctcttggtaactttattactgttcacgatatgttgaagagcgttgacggacaagtaatacgttttttcttagcgacacaacagtatcgtaaacccgtgaatttcactgaaaaggccgttcatgatgcggaagttaaccttaaatatttaaaaaatactttcaacttaccaatccaagagaatgctaatgatgaagaattagagcaatttgtgaaagcatttcaaggagcgatggatgatgattttaatacagcaaacggtattactgttatctttgaaatggcaaaatggattaattcaggacactatacttcaagagttaaggaaacctttgctgaattattagaaatttttggtattgtattccaagaggaagttcttgatgctgatattgaatctttaatagaacaacgtcaagaagcacgagctaatcgtgattttgcaactgctgatcgtattagagatgaattagcaaaacaaggaattaaattgttagatactaaggatggcgtgaggtggactcgtgattgatgttcgtttgattaatggtattgctttagcttttgaaggagatgcagtttattctttgtatatccgacgccatttaattatgcagggttttaccaaacctaatcagttacatcggaaagcaacccaatatgtttctgctaatgcccaagcattgttaattaatgccatgttagaagaaaatattttaactgatgaagagcagttaatttataaacgaggacgtaatgcgaatagtcatacaaaagctaaaaatgctgatattattacctatcgtatgtctacaggttttgaggctcttatggggtacttggatatgactggtcagataaagcgcttggaaactctaatacagtggtgtattgaaaccattgaaaaataaacaaaaagagaggctatatcctctcttttttatagagacattaggatttgttggtaaaatattgctataaaaagctttatgctatagcattcatgatataatatgactatgaaagataaacaatttaaagaagaatcaagtgaccttgtctatggcttacatgctgtgacagagagtttaagagctaatactggtaataaattatacttgcaagatgacttaagaggaaagaacgttgataaagtcaaagcactagcgactgaaaaaaaagtatccatttcctggactcctaaaaaaaccttatcagacatgacaaatggtggagttcaccaaggattcgttctaaaagtttcggaatttgcctatgcggatttatcagagataatgacaaaggcagagaatgaagaaaatcctctcattttaatccttgatggtctgaccgaccctcacaacctaggttctattctacgcacagctgatgcaaccaatgtaacaggtattatcatccccaaacatcgttctgttggagtgaccccagtggtttcaaagacatctacaggagctgttgaacatgttcctattgcaagggtaactaatctcagtcaaactttggatactttaaaagataaggagttctggatatttggcactgatatgaatgggacaccatcgcataagtggaataccaaaggtaaattagccctagttattggtaatgaaggaaaaggtatttctcataatatcaaaaagcaagtagatgaaatgattacaattcccatgaatggtcatgttcagagtttaaatgccagtgtcgcagccgctattttgatgtatgaagtatttagaaaccgcctatgaaaaaacattctatcttactcgttgatggctacaatatgattgctttttggaaagatactcgacagctttttaaaagcaatcgtttagaagaggcaagggaagtattacttagaaagctaaatcattacgcacatttcgaacacattgatattatttgtgtatttgatgcacagtatgttcctggtgtacgtcaacgttatgaccaatacaaaatatccgttatctttactgaggaggacgaaactgcggatagctatattgaacgagcagcggcagaacttaatcaatctgtgttaaatttagtctccgttgctaccagtgatttaaatgaacaatggactatattttctcagggtgctttacgtgtctcggctagagaattggaacagcgtgtagcgacagtaaaatcagatttggataagatgtccagtcaaatcgatttgagtacgccaaagttaaggccgtggaatgatgaacaactaggaaaactcaaggattttttagatggtatgtaaaacctaacactttattagccagccaacaatttttttgatataatattggaactactttgattatcaaataaaaataatagattgaggtaacaatgacttttaaaatactaacggattcgacatcggatttagatgaaaagtgggctcaagagcacaatgtcgatattataggtttaaccattgaacttgatggaaagacttatgagacagtcggagacgaaaaaattactagtgacttcttgttggagcgtatgcaagagggagcaaagcctacaacaagccaaattaacgttggtcagtttgaagaagttttttcaacctatgcagaaaatgaccatgccttgttatatttagcgctatcttcacatttatcaggcacttaccagagtgcaactattgcgcgtgagatggtcttagacaaatatcctgatgctcaaattgagattgtggatacgatggcagcttcatgtggtgagggtgtcttagcgatgttagcaactaaagagcgacaagaaggtaaatctttagaagaagtgaaacaaaaaattgaatcacttctccctaaattaaacacatactttttagttgacgatctcaaccatttaatgcgtagtggtcgcttatcaaaaggtgcagctatcattggaagtgttgctaagattaaaccattacttaagttagatagtgagggtaaattagtaccatttgccaagacaaggggccgtaaaaaaggtattaaagagattgtgactcaggcaacaaaaacactatcttatagcactttaattattgcttatagtggagagaaagattcagctcaagttatgaaagaacagttattagcagatgagcgtattgaagaagttattattcgtccattagggccagttatttcagctcatgtgggctcaggtgctttagctctattctctttaggggaagaaaaccgataacaaatcaaagggcataacagtacgttatgttcttttagtatacattttataaaatgtattttatatgatgctatgaaactataaaatagtaggagacctattataaaaaataaaataagaactatcctcaatatgataaacgacaacaacaattggttttacaaagttatcaaaaatgtttttagacgatggtttttatcttatggcttgaaagtgtttttggaaagctaataaggggagtgtgttacctgattttataataatattaactttatttagtggtatttctattttgttacgacttctaatctaaaaagcgtctctccgtttgttgatgaaagtttttggaaaatgtttttgttgctggcgcatttgccctcataggaataactattttattgatgcttttactaggaaggttgatattgctacttatttttcaaggggagatgatgcaattttagcagttataggaatatcattgatagctatgggaatttcagtgtactaccataagtataaggacagatagtaatatgaaaaatttacgcttaaagacggctagagctagtatggatttattataacagtctctagctgaaaaggtcggtgtatcatgtcagacaatagccgccattgaaaaaggagactataattaagcgattaaattgtgtcaagctttgaataaaactgtagatgatttattttgggatgaaaattgataaaataaaagaaataacttgacgaatgctaccttattttgatatgattataagcggtattgtttaccccatttgtaaggccccggaacctttcaaatactctcgtggaccggaacatccacacctgtaaacaaaaacgaattcgtataggagaaatcatgaacaaaacaactttcatggctaaaccaggccaagttgaacgcaaatggtacgttgttgacgcagcagatgtacctcttggacgtctttctgcagtagttgctagcgtacttcgcggaaaaaacaaaccaactttcacaccacacactgatacaggtgactttgtgattgttatcaatgctgaaaaagttaaattaactggtaaaaaagcgtcagataaaatctactacactcactcaatgtatccaggtggtttgaaacaaatctcagcaggtgaacttcgttctaaaaatgctgttcgtttgattgaaaaatcagttaaaggcatgcttccacataacactcttggacgtgcacaaggtatgaaattgaaagtatttgttggcggtgagcatacacatgctgcacaacaaccagaagtacttgatatctcaggacttatctaagaggaaaggagcattatataatggcacaagcacaatatgcaggtactggtcgccgtaaaaacgctgttgcacgcgttcgtttggtcccaggtactggtaaaattacaatcaataaaaaagatgtagaagagtacatcccacacgcagaccttcgtcttgttatcaaccaacctttcgcagttacttcaactcaaggttcatacgatgtttttgttaacgttgtaggtggtggatatgcaggtcaatcaggtgcgatccgtcatggtatctcacgtgcacttttagaagttgacccagatttccgcgattcattgaaacgtgctggacttcttacacgtgacgcacgtatggttgaacgtaaaaaaccaggtcttaagaaagctcgtaaagctagtcagttctcaaagcgttaaaaactgctttacatcaacgattacaagcattttgcaagtctcttgcaaggtgctttttttgtcgttttttgcttttgataccttttttgataccgtttcggaaaaacttctccatcttttttgactgttattttgcttttagatagtccgcaaattgtttgactgacctatcttctccagtagttgtcgaatgactgtaagtatctaaggtcatttgactacttgcatgccccagtctttttgctgtgttgactgggtcaactccaatctcaatcatcaaggtagcatgagtatgtctaaaaccatgaggactgattttctttaacccgtgttttctgataatccgtgataggacgttgttgatatagtctgcatgtagtggctcaatagagcctgaccgtgtacaataagtgaagagaaaatcttgctcgatagaaagaggtgcaactgctagttgtgccttttctttttggctgatggatttccattcttgcagaatagaaatagtttcgctatctagcttaatctttcttactgagaaatcatttttagtgcctttttcgattgcctgtccgtctaatcgtcctaagctcttatcgacacttagtgtctcagtttgaaagtctatatctgcccacttaagagcgtatagctcgcctttccttaagccactgtaagctagtaatctaaatagtgcatagtgtttgtaaggctcttcctgaaggacaatggctaggaactcctgaagttcttgaaccgtccaatagttttctatccgtgtctttttccgttttggcataatgatttctgccatagggttatgcttaagcagtttcatcttgatagcaaaatcaaagaccttcccagtataggacttgatttgcttgatattcttaaaggtctttgctttatctgtgatgaagttctggcagtctaaaggggagattttgctgatgggtaagtctcccataactggcagaatgtgaagtcgaaacatatcaagagtacgtgaagcagttgttggctctaccatatcttgataggcttgataccatttctcgaatatctcgttataagttttatgagttggtttgatgaactcttccaactttcctgaagccttaagataaatgagtctggcttcgtagtctttggcttcctttcgagtacgaaagccacgtttgatatggtctgcacgttgactgtctttgaccatatagattttgacaaaatacaaatagccatttttggcttttttgcttgggtatttgtgaatggacattgtaatttctcctttatttttctaaggtttcggagcttataaaataaagaaattacgttgcctattatttttttaaaagttctaatctctcttttacttctttatcaagagtttttcgaagatttttagcctctgcttcaagttcatcaattttctggttaagcttgattttttcttgcttaatttcctcaagtctgtcacgtatgggagagttgaaaagagtttttttgctaactttttcaagggtttcaagagtagaaaaataatcttgacccatatcctttttgacttgttcaaaaaaacttaataaatttgtatctttgattgttgaatttgctatttttgaattgttatcaagccctagtaagtaagggatagatacaccgaaaaaatcagctaatattttagaattttctatgctaagactagtttttccgttttcatattttccatattgagattgattagtattgatgactttagctagatcagcctgagttaaccctttgtcttttcgtagttcttttagtctattgtacattattccctcatgacttttattgttttatataaagcattatatcacaaataatcaaaatttaacttttttcttgacataagttattttttaacttaaaataatagttataaaataactttttcggagtttataaaatagagaaaggggtcagttatggcttacacactagaagaacgagaaacgattgtccgttatgatgaaatggataactgttggtattttgagagtaatgttaggaaacacattactaaaatcatgaaaactattgatagttgtcagattttaggtcaagagaaagaagacgaccgcattatatggattcatgctaaattgacaaatcttgatgattatatggtttctccatttgttcgaaaacgagttaaacgtgaaatgactgaagaacaacgagaggaagcaagaaaaagaatggcaagattacattctaagtctgaaatatgattctacaatcacaaataacagattaaaaaccttctcaggtatatttaccctaggaagatatttaaattctgaaatacttgattacaataagcgtttcagagcttaaaatcgattttaacaaaaaggagaactcaaaatgacagaaggatttaccattcagctccccaaagtaactgaaaagaagttactggctcgctatgacactatggttcaaaaagcaatagaaaaagcccttgaggacaaagagctatataagcctatggttcgtatggctggcttgtgccgttttttagatgtctcaacgacaactattgtcaaatggcaaaaggcaggcatgccacatatggttattgacggagtgactctgtacgataagcgcaaggtcgctcaatggctacaacaatttgaaagataggaaatttggcatggataaaaataatttagaagacttgacaggaaaaaagatacttagaaatggttttggtggtcttcgtttggaatatgggacaatctttcttgatgttggattgttcacttatattgtgctgatactatcaatatttttctttttagttgaacgttggtttttgggagctttaacttttgtgttgcatgttcccttgcttctacttgggatatggtgtggagagagataggaggtaagaactatggactatgataacgacagctatcttatcccgaaagttttactgcaagatgatttctacagtagtctatctgcgagagatattttagtctatgctgtcttgaaagatagacagatagaagctcctgaaaaaggttggatagatactgatggcagtatatatctaaattttaaactgattgaattagctaaaatgttttcttgcagcagaacgacaatgatagatattatgcaacgactggaagaagttaatttgattgaacgagaaagagtagatgttttttatggctactctttaccctacaaaacctatatcaacgaggtataagcaatgataaagatttattttggaaaagatataacacttaaccaagctattcagtcgcgattggatagctatcagattgactatcaagcattctcaagcaaagatatagatgctaaaacactgatggaatggctattcaggtcgaccgatatatttgaattactaagcactaagatgttgaaatacaagctgaatacacaaattaccctcagtcaatttgttcgaaagattttaaaagatgtcaatagcaccttgaagcttcccattgttgtgacagatgaggttatttattcgaacatgtcccctgactatgtgacagtactcttgccaaaagaatatcggaaaattaaaagaattcagctgatgaggaagatggagcagttagatgagggacgtctattctggaaaaactttgagtcactacgtaagcaatctgagctacgttggtttgaactgaatgagttactgtttgctgatatgtccgacgatttaggagaaatcaaaaaagctaaagaccgtttctttagctacaagaaaaataaacaggttccgcctgatgacattatcgaaaaaatcctcaagatatttttggttgaccgagaagactttttcaaaaaatctgtgttggattgacaaaatttctagtcaaaaatatttatgaaaataactatgaaaatattttgaaaacagagatttgaggtcagatttattggggttctgaaaaatttataacagggcgccctctaacagcccgctatgtgcacatctgaagtgcatttactacacccgttttttggcaagtttggctggagcaaaatgaaaatggtccgactccgaaggggtcggcttggggctactcccccaagaatgtcattttacgtaggcctttgcgcagacaaaaaaatcggcgccgttaggcgaccgccaaaaagaaaggaggtttgtttgaaattaaaagtcagcttagacaatatcactatgacagcctatatcaaatctaaaaagtatttagctatgaaacaactcatagaaacccatttagctattactgttcaaactgcgatgactgacatgtttcgagccaccactggggatggaatccacgttgtgctccatatgaattatgacaaacaaaaaggacaagaccgcaaggctcgtccatttcgcttggagtttaatcccaataaactccgtttagttgacagtgaaattatagatactattataccatttcttgaagatatttcaatatcacgtgctgatttagcttttgatctatttgaggttgattgtagtgagtttgtgctcgaaaaaaagggcagaccaaccgcaaccaaggaatttcgttctagtactggaacgttagaaacaaaatatctaggtgctccacgttctgaaaaacaagttaggctatataacaagaaaaaggaacaactccaaaatggtactgataaagataaagactttgcaagtcaatttaagcactggtggcgcttggaatttcaattaagaagccgttcaattgatgagatattcgaggttattgatactattatttttaaaccattcaatcttaaaggcttatctattgagacccaaatctatctaactgctcttattcacgataaaaatatctggaaaaaactccatagaaatacaagagcaagatacaaaaaaattttagaaactcatcaaacatcagatactgattatttaggtttgctgaaagacttgttgaagcatgaaagaccaagactagaaaatcagctcgcttattatgggggtaggatagacaaaaatagctttcaacccttttgttgaaaattcagtattatcaaggagttacgaggtcaaaaatgagaataaaagattatgctgatagtctaggagttagtagccaatctatctataaacgcatacgctctccaaaatataaagaaaggttgaaaggtcatttataccgagacaaccaaaaggttgaaaatcttgatttgataggcattaaaatacttgaagattatcattttgagaatgatgtcattgaactggaaaaaacgctgggtgatattcaagaagaattcgagcaagaaaagaagggaatgcaatatcggatagatagactagctgataagttaactcctttacttgaggataaccaaaacttggtacaaaaaaattatgagttactcaactatgttcggagcttggaacgacagaagctattgctgattattgctttagctgtcatggtaatcactttattagtggcaatatggcttgccatcttttgatggcaattgtcggacaatgcgaagcgtccgaccaagggcactgcttaagtgctctactcgcttcggcgagtataatcgaagctcctcttgtggctcgagaggtggttcgaagtcgctcctgtattcggagcgaagagctgtctgcaagacccttcggagaacgcacatttacgtagtaaagtgtagtgcgttacactttacatggaagttatgccgatcccctaagaagaaatccagataataggttgcttattcatggtggcaattaccgccaccatctcggcgaccttttgagccgagaaaggagaattaaaaatgagttatgttgttgctagaatggctaagtacaagtcaggtcagttgacggctatttataatcataatgaacggatttttaaaaatcactcaaataaagaaattgacgttgagaaatctcaccttaattatgaactgacaaatcgagaccaggcacaaaattatcacaaacaaataaaggagcacatcaatgaaaatcgcttatctactcgtggagtccgtaaagatgctatactctgtaacgaatggattattacttcagataaaacgttttttgactcgttagatgagaaacagacacgagagttttttgagacagctaaagattattttgctgaaaaatatggtgatgctaatattgcttacgctagagttcaccttgatgaaagtactccgcatatgcatttaggtatcgtgccaatgaaaaatggtaagttaagttcaaaagcactgtttggaaataaagagaaacttgtagcaatccaagatgaacttcccaagtaccttaatgagcatggctttaacctacaacgtggcgaaataggcagtaagaaaaaacatttggaaactgctgaatttaaagaaaaacaacgattactggataacgctgatagaaaactagctgataaacatgaagaattgaaagcacttgatgataagatttcaaatgttaacgatacaatagctgataaagaaagtaggcttaaagaattggaagcgaaagaatgggatgctgttggcgatttgaagcagtatgaattagagaaacagtcactagctgaaagcattgaagacataaaagacattgaactattacaacttgatagaattcaaaaagaagatttggtaaaacaaagctttgatggcaaattgaagatggataaagaaacctataatagactatttcaaactgcttcgaaacatgcatctagtaatgctgagttaaaaagagacttggttaaagcccagtcgcagaacaatcacctttctagagaattactcaatcaccgtaagacagctgaaaaaaatatcaaattaagtcaagaaaacagaaaattaaaggacaaagtaaaaatgcttgatgaacaagtgaaaattctgaataaaagcctctctgtttggaaagaaaaagctaaagaatttatgcctaaacaggtttatagagaaacattatcaatcataaacactctaaatcctattggtttagctaaaacagcaatcagacaagttaagaagatggttgatagtaatagttagctacttttatgccgtgaaagtctcttgataacaagctaggcaagtttagactagatggggtcgagtcgtcaggctaaagaactggcgaccgatcgccatagactaaaacagtctaggttacttgttgtcaagagaaccatggaataaatgagtaaggagaaattaaaatgacagataaaaaaattgtttattactttgaccatgacttatcaaaaaaagatatgggaggagtaggacctacctacaccggtaaaaatcttttattcctactttggtggacatattcttatgtggcagaagacaatttagacattgatacgtcattgtttgaagtcccagaattcaatgatttttacaataatggtctagagctttatcgtataaaaaatgaactagctaattacaatatcagatttggatatgaggttaatccaaaagatagtacaaagatgctgataggtattttgccaactgatgaagaagattatgttaagggatatagaaattttattgctgatatttccaatcctgacacacgttacgcaatctatcatcgactaattaaaaccatggacacaatgctaccgattgaacaaattaatgtttataaaagccttgcaaaaggtaataaaaagtgatagagtggaagaaagttgagactgagtttgaattggtaacaattcattcaaaaaatacttattgaaggtattaggtagaggtgttgcctcctgagtatacttaggtaaatccccgattgggttctcagcttttacattaggagaaggttgattgactggtaacagttttctcaaaggtattgtttgtcaatacagggttggctctgccttgtggaatatctactaaacagcccgaactaattttgctcctagttaatttgtaatcttcaaaaagccttggtattacgctaaggctttttgattgctatttaaacaatttcatatagtcgcttcgagtaggaagcaagtaatcaataacgaccctattctcttcctcctcgatatggtataggacaatataatctttacttaaggtataacctctagtgctgtggtacttactgatttttgaaccatatttttcatcggcatcaaaaccaacttcagggaaaacctcgagtttttctatgtcactaatgatttgctccattttgtgctgacctgatgtcgaggaatagttttgagaaatataatcacgaatttcctttaacttctctaaaacatcaggagcatagataatctgatatttcttatagtccaagttcagacctcacttcttcagaggtataaaatttcccttgacgaacatcttcaatatttttgttgatttcagcttgaaattgcttgaaaagtttttctttctctagctcctcttccgtcaataagtcaacctcatttgtgacaacgacattttgaaggaataatcttaaagcagatgataaggttaaatttttcttgtttaatactgtcattgcttcgcttaccaattctttgttagcttggaatgtgacagctctatttttttctgctgtaaccatattatgtaactcctttatttagtttatttaattatctcatatacataaaaaaagtcaataaaaaaatcccaattgattgagatagctttcgtttattttataagctccgaaactacagaaaattgatacctttttgataccgtttaggtttaaatatttgtctataaataagaatttcagtgattttttattttagaaacgttgattttaaagggatttgactttaaataatggagtgaaccaaaaaccaggtcttaagaaagctcgtaaagcttcacaattctcaaaatgttaatcagtacgattatatcaacgtttcaaagcactttgcaagtcttgcaaggtgttttttaaaaccttttgataaccctttctgttttgaaagtaaggtaaatgtaatataaatcgctgtttgtatttttaatagattaacctattatgagttttatctgtgtaaggaacatctaaatatgctatactgcagttaaaaaaatagggagcaaatgatgtcacaaattaaactaacacctgaagaactccgtatttcagcacaaaaatatacaacaggatcacaatcaattacagatgtgttaacagttttgactcaagaacaagctgttattgatgaaaattgggatggtacagcatttgatagctttgaagcccaattcaatgaattatctccaaaaatcacacaatttgcacaattattagaagatataaatcaacaattattgaaagttgcggatgttgtcgaacaaacagactcagatattgcctcacaaattaataaataattggcttattcaaattcataagtttaacttaggaaggcataagctctcctaagttgatatattatagctagatgatgtaattgtttcataaaggagtaaaaatgaaaaagagtacccaaataatactactaatagttgcattattcatacttgtttttagcggaggattttatatgaaagaacaacaaagaaaagaagaactaaaacggaatcgagaatatgaagttagtctagtcaaagcattgaaaaattcctatgagaatatagaagaaataaaaatcacacatcctgtttcaactgaaattcctggagattggcattgtactgtaaagatttcatttaatgataaaaaatctattgtttataatattacacataatttggaatcgaaaaaaaattatagcggaaaatttaatgaaaaaaatatgaatttttttgattcaagaattggtaaaacaaaaaaaactataaaaattattttttcagatggtcaggagaagatacaataatggtatttacatataccgagaaagaacttcgtgaattcaatattggagataatgtatattcagttaaccccgattatgcagaaaaaaatcattcaactgtcataacggatttaccccagaaagataacgaaacaaatattattacaacagaagatagaaaaaaatttaaggtattaaaaacttctcctgacgatatgtctggctatcagggtatggcagttgcaccaattatcaagggtaaagtagattataacagtgttgcagttatatccgccgcaacggattcaagtaattataaagatttaattggcgcagtttcatctgctcaaccacatcaaagttcgactcagttaaaatcagctgataaatttttaaaagacgtacagtcacatgacaaatggactgtgactcagctttcaggctattctcaatctgcatatatgttaaaattaggtgctcaatatcatatcccgactacagtatttaatggatggtttaggtatagcactttaaatgaagatgaaaaaaattcatggctaagcatcctgaatattttgtgaattttcgacataaagaggataatgtaacttggtggaacgattttaataaactagatgataaagattatggtaccgtgaaatgggtaaatggtaaaagtcataaaatagagagttggaaatttactgatgatggtaagttaaaagatgaaaaaggtaacatcgtaaatcctaagtcaccagctgttcagtctgttctttatgaagaagttcattttcaaaaagctaaagctaaattaaaaaaatctggaggcaaacttagtcatagtgaaaaagtatatttagattctgaacaggctatatttattgctaacggtttaaccacggcatctcaaacagcttctgatgatatcaagaagaatgctgaattagttaaagaaaaagcatcagaactatttgcaaaaactaaagtgatgcctcctggtataacagatttaagtccggaagaattagctgatacatatagtgagggcggagttagagaggacaccatagtaacaccaattgaaactttctttgatgaaaaagttactaatgcacaagagattacaacttcatatattaatcttcaaaaacaaattgaatctggtgtccaaaaattgctagaagaggactccaaattagcaggagaatttaaggaatggtcacagtactagatcaaaatgaaaacaaaattaatagtctaaaaataaacctagggaaattggaagataattatcatcgcgaaaatatggagatagaagataaattatatagccttgaggataaaaagaacgagttagagacttatttacaagaagtctatgaagagacaagtcaccttttgagacaaaatgattcagatggttcgacttttatgagtttaaatcgaataattgaaagttatcaaatggaattaattgatgaatatgaaaactataaacagactatcattgtccaagaggaaaatagtcggacacagtttctaaaagaccgagtaaaattagaaaatgacatttctagtttagaaggaagaaaatactactaattcagatggactataaagtgaaagaggcaataaatgagtttaataggcgctgtattgaaaggaaccaaagaagacaaagaattcaaaaagcaaattcaaagagctttagtaaggattgtctatgcccctgaaatagtagaagaagctgattctattaagatgacttatagtgacaagattgataatgtttctgagacggccaaatcatcaattaaaacgatagcaaatcaaatagattcaggacttgtaggacaatttggggaaaaagtaaaggcacaggtagatttaaataaaggtagttatgatgatttataatcgagtgaaaatgttgaggaagcttactatcctgatagttattatagatatgaaaataatcaagttggattagaagacataacattttacatgaaggataacaaagtttattatttacattttggtaaagcaatagataaaaatgaagctaaaaatgataagtatctcaatcaaattataaataattaatttctttattttataagccccgaaaacaaattttttgataaccttttgataacccctccgcgaacatattgtaatacatagtgcacttttgggatataaattgttgatttttagctagtttataccatataacaccatatattacagttgtcagagaaaaccaggtttaaaaaaagcccgtaaagcatcacaatcctcaaaacgttaatatatacctatatatcagcgattggaagcacttcatggttcacaccatggggtgttttttgtgtaatattcaaaaattgtcctaaagtcatttttaaaacttctaaatacttgagaaaccattgtaaatttaaataactactttaaatagcacaaaggcaatgacaaagttagatgagatgattctattttaatttataattgaaaaaaagagtatatgatggaggaattttgtatggtaagtactcaatatatgaaagtaaccttacgagaaaaattcccagataaattaacatatgttgatttagaagaacttgtgatatgatattacaaataaaagaaaatgactatatatcagctcatatattggttaaagttggtaaatataaattattgaaattacctcataagtttaccaatgagattacggttagaaaggaatactaatgtttaaatatgtccctatttttagggaatttcgacttaatcgacagttttctcttaaacaggttgcttcaaatgaactttctgtttctcagttatcacgatttgagaggggtgaatcagatttatcattaacaaaatttttaggggctttagaggcaattgatttatcaattagcgaatttatggatagagtaaataaatatcaaaaatctgatcagatatctttaatgtctcagatggctcaatatcattatcaaagagacgtagctgggttagaaaagatgatttctgtggaagaaggtaaactaaaaaaggatagttcagatatacgttgtcgtttaaacatagttctttttagaggaatgatatgtgaatgtgactcctcaagaaaaatgtcggaagaagacctttgctttttgtcggattacctctttcaaaaggatagttgggaaattagtgactatattttgattggaaatctttaccggtattacaacacaaggcatatttgccaacttgttaaagaggttatcaatcaaaaggaatattatcgagatatttatacaaaccgcaatgttgtcgaagcaaccctcctaaatgtggtagagacactaatagaacggcgcgctctagaagaagcaacgttttttctagagaaagttgaagcacttttaaataatgagcggaatgcttatcaccgtattattttactctatgaaaaaggatttcttgcctatgctaaaggggatagtcgaggaatacaaagcatgaagcaagctattttttgcttccaagcaattggttctaaacatcatgttgaaaattttcaggaacactttaatagggtaacaagattataaaaaatcccatttatgggattttttaatatttctccttttggtttgctataatgtcgaactaaggagggaattatgaatattaatggtataaaattactatctagtcgagcagtcagtaaacttggtgatgtgttttatgattatggaaatagtacttggattgcttcgatgggtggtctaggacaaaagattttaggtatttatcagatagtagagttgttggtttctattgtcctcaacccttttggaggcgccttagctgatcgctttcaacgaagaaaaattttactaataacagatgctatctgtgctatcatgtgtttcttactttcttttattggagatgataaagtaatggtgtatggtctaatagttgctaatgctatcttagcggtttccaatgctttttcttctccggcttataaatcttatattcctgaaatagtagataaagctgatatcattacctataatgctaatctggaaaccattgtgcaaattattagtgtaagttcccctgttttaggtttccttatttttaataattttggtattaggattactttaattgttgatgcgattacttttttgatctctttcctgtttctttatgctattaaagtggaaagggtacagctttcaaaacaagaaaaggtagcgataaaaaatattttagctgatattgcagatggatttacttacatcaaaaaagaaaaagaaattatgttttttctaattattgctgctttattaaacactttcctagcaatgttcaattatcttttaccttttactaactccctattaaaaacttcaggtgcttatgcaacaatacttagtatatcagctatcggatcaattattggagcgcttattgctagaaaaattaaatctagtattaattctatgctatctatgctagtattcagtagtttgggagtcatagttatgggattcccatctctatttgaattaccgatatggataccttacagtggtagttttctttttaatagtcttctgacaatgtttaatattcattttttcagtcaggtacaaatcagggtcgatgaagcgtatatggggcgtgtgatgtcgactatatttactattgctattatgtttatgcctataggaacactatttatgactatcttttcatttgccttatcaaatgttagctttattgttataggatgtgccattgctatattgggaggattaggatttagctatagtaaaaaacaattttagaacttaagaaattattctgaaacatcaaaaaaacttgtctctactgacaagtttttaatagttattttcttggttcaagcatgcgttggataccgcctaggattaaatcagagaaaattgccataagggctgttggaagagatcctgctaagataatagcaccaccatttgttgcattagttcctcttatgatgatatctccaagtccgcctcccccgacgaaagcaccaatggctgtaataccaattgctacaacaagggcatttctaagtccagccatgataacggaaatagatagtggtaactcaaccataaataaacgttgacgcttagtcatgcccattcctttagcagcatctagtaagtcggagtcaacatttctaataccagtgtaagtatttgtgatgattggcagaagagaataaagaaagacagttgcaactactgttttaatacctagccctagacctaacataatgatagagatcatagctaaagaaggaatggtttggatgacatttgcgattcccataacaaaggttttaattttaccacgtctagcgatgaagatacctagagggataccaacaattgcagctaaaataacgccgtaaactgaaattaaaaagtggtggataaattgttctaagatataactaccattatgttggaagtagtagataaattgttggaaagtattcatttgtttcatttatttatctcctctaaaataatggtttttttctaaaaattgtttggcaacaactgaaggttctaaaagtttatcatctaccatataattaaggttttgcatcgtttttaaattgattttaccatcgagtcgatggagtaatttttttagtttaggatcttttttgatgatagaattgttgacaaccatagaggcttcataaggaggaaagaattttttatcatcccttaaaatttctaaatcatagctcgaaatacgaccgtcagtggagtagcctaatacagattgcattttgttactttcaaccgcatcatagactaagccaatttgcatagggtaaatatgtgaaaattcaaaaccgtatgttttagcgaaatcagtgtatccatctccctcgcgattcatccatgaactatcaacccctgccttcatagttgttgataattttttaagatcagagatcttagtgattttattctgtctggcaaactctttagtaaccatgaatgcataagtatcagaaaaaccataagtaggataccaagtttgattgtagcgtttttggaattcagtttttacaatcttagaagcttctttagggtctttaacagcttttaaaccaagagtccctgtgatgtctgttcctgtataacgtgtggcagcaatgtcagcatcaccacggagcaaagcttggtgagtaaccgtagaggaaccaagattgcttattaaagttgtgttgtatcctaattcgtgatgaattaattcggtgataatatttgccataatactagactctgtagaactttgggcagcaaccttaattgtggtatgaccagactttttagtatcggttaattgacaaccagaaatcgttaagagggctaagcaaagtgtaaatatctgtaaaaagtgcgattttttaagcatatctaagcctcccttcttgttgttctgggcgttagagctgtttccagtaatcctaaaagataatctataataagtgacaggataataacaggaattgtgccccctagaattaatttggactgaaaaagatttaacccgctaaaaatgagatcaccaagtccacctgcacctatataagaagccaatgtagcccaagcaataacataaatagtagacaagcgaataccagccataataattggagtagctaaaggtaactcaacttgaaatatagattgaataggtttcattcccatccctttagcacaatctttaagtgttggattgacattattcatacctatataagtattccttagtataggaagcaaggaataaataaataaagcaacgatagctgggatttttccaattccaaacaatggaatcattaaagctaataaggctaaacttggtatagtttgtaacatgctagctatagcaatgataattttggctactttgggaaaacgtgttaagaccacacccaatggaacagcaattgcaatcccaagtgctatagcaaagaatgagatatagacttgttcccatgtttttactaatatttgcatgccatactgtgataagaaattgaccattattgatcctccgtttcagtatcgccccaaataatatcgtataacatatcaactagggatgcacgagtaacaatgccctttaagttattctcatggtcaacaactggagcgtattttaaaccaagttttaaaatacgctcagcagtatttctaagtaagtcgtcttccataacataaaaatcagtatgttttaagatatcagaaacaagtcgatctttcttatatttactgcttagagattctaagtcaataaaaccaattaatttaccgttatcggttactagaagtgagtcaacgcgtttttggcgcattagtgtaatagcttcagttagtgttttttcagcagttattgaaacaggattatttaacattatctgtttaacaggagtaatatcagcctgcgcatgaaggagacgctcttctccaatcatttgttcaacgaaactagtagcaggatgatgtaagagatcattgggtgtcccttcttggaccattttaccattgtccataacaataatttttgttgctaacttgagggcttcatccatatcatgagtaactaagatgatagttttccccatttcttcctgaagagacttgactaagtcttgaataccttctctagtaataggatccagagctccaaaaggctcatccattaaaataatatcttggtctgctgcaagagcgcgaatgacaccgatacgttgttgctgaccgccagacaactcactagggtagcgatccaaatattcttcgggtaattcaactaatttaataagttcccttgctttagctcttttagcttcttctgaccatttcaataattttggtacaagaactatattttcgtaaatggtcatatgaggcattaaaccaatgttttggataacatatccaattctgcgtcttaattcaatggggttaatagtagaaatatcttttcccttaaataatagagtaccatttgttggttttaacatatggttaaccatacgcattaatgttgttttacctgatccactcgtaccgatgaaacaaacaaaatcaccagggtaaattttaaggttaatgtcttcaaccgcaacattttccccatacactttattgatattttgatattcgatgataggttcttggcccatattattctcctctacaaactatattatagtaataatatcaaaactttggcaacatgtctgaaatttgttttaaaatttaatgattttaaaaagaatcgttaagcttgagcctgatctacattttcagaaaatgtagaaaaagtatgaaaaaagagttgacaaagtaagagatgatgtagtaaactaaataagttgtctcgagagagcagtttctattagcgcgtagttaacaacttaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccatagaagcgggtgtagtttagtggtaaaactacagccttccaagctgttgtcgcgagttcgattctcgtcacccgctttactttataagaaagtaaaaaccaagcaatagcttgggcgcgtagctcaggtggttagagcgcacgcctgataagcgtgaggtcggtggttcgagtccactcgtgcccatcaagaatatggtccgttggtcaaggggttaagacaccgccttttcacggcggtaacacgggttcgaatcccgtacggactattttttgttatatggaggattacccaagtccggctgaagggaacggtcttgaaaaccgtcaggcgtgtaaaagcgtgcgtgggttcgaatcccacatcctcctttaaagatatcgcgggatggagcagctaggtagctcgtcgggctcataacccgaaggtcgtaggttcaaatcctgctcccgcaataggctcggtagctcagttggtagagcaatggattgaagctccatgtgtcggcggttcgattccgtctcgcgccatttataccttaggagagatagcgaagaggctaaacgcggcggactgtaaatccgctccttcgggttcgggggttcgaatccctctctctccatagtaaacgggcatagtttaaaggtagaactaaggtctccaaaaccttcagtgtgggttcgattcctactgcccgtgttttttctaatatggcgggtgtggtgaagtggttaacacatcagattgtggctctgacattcgtgggttcgattcccatcactcgccttttcatggggtatagccaagcggtaaggcaagggactttgactccctcatgcgttggttcgaatccagctaccccagttttaagatagccggcgtggcggaattggcagacgcgctggactcaaaatccagtgtcctcacggacgtgccggttcgaccccggccgccggtatacttataaagacaaggtttctaaaccttgtcttttttctactagataatttattgtgaaatgttacttgtaatatatatttatttttttcattgtagaagaatttatataataataaatattaattattaatttaattagggcatttaaaatatacaaatgattttctgtttacatgttaagactaaaactataaaaatacgtgaaaattttgttatactaaaattaattttataatgttggtgaataatagttaatttcattatatacttgatatataaaatttatattctaagaaaagagaacatgatgagaaaatatataaaatggttaattcccatatcaatttttgggatgatacttggaggctgtcaaatgaatagtgaacataaaattcagtcaaacgaagtaaaaaatagcaagcaatcagaagtgaagaaagataaaaaaatgacaaaaaaagaacaattagcctatctcaaagagcatgagcaagaaatcatagattatgtaaaattacataacaaccaaattgagtccgttcaattcgattggtcaagtgtaaaagtagaacaaagcgggaatggaactccacaagggggtgattataatctttcactgagaggaaagtttaatcatctacaaaattcaaaattaatagttgatttttatttagctcataaaaatgatatcccaaatatcaaatcaatgggaatgctaaataagccgtatatacataaaaatggtatttggcacatttatgaatagcttgaatcatcctatataaagtaatagaatttttaccacaagcaaggtagaggagaagaataattgagtaattggaacttagataattttgataacttacatagctctttagcagaaagtgcatataatagtcgacctaattcatttcctgaattatttgagactgactcagtaacagaagtaaaattttctcaaccctcagaagataacaaaggtcaaatcacacagggtggcactaacctccccaatgatggtattgtctacctgcaaccagataagtccttaaaatctattgatgaaaatgtaaaggtcctcattccagatgtcaatggaggctatcacactgagcattatgttactcattcttatcaaaaaggtgtgcttactgacgataaggcaggttttaatgcttactacctgtcagatactgaaaaaatagatagcactacaaagcacacttatctagccattcgtggtagtgatgggattggtctagatacactaaacgattgggttagtaacaatgcaatgtttgctgtctctaacaagtatattccacaagcgaaattggctaataaggctatgaaagaaaaaattgccgagctaaaaggaaaagcgcctggagctattatagatgttactggtcactcactcggtacgattgtatcttctcaagcagttgttaatcttagctatgcagaattggagaatgttggtcaagtagtccttttcgatggccctgatgtatcaagaagcttggaaaaaatggaaggcatttctgctaaaaaaatccaagaagctgggaagcatgttacctactatgtcaatccctttgatatagttagtatgcttaatcgtgaaaagccatagaaagaccaattcgggaaagtaaatgtcattgttcctagtaaatatacgggtacttttgatgagcaatcttctcacgattttggtgccttccaaattgatagtagcggaaatcctttagttgcttctgaaagctatcatccagaattattaacatctggtcaagacttagctagactcgaaaaaaaattcataaagaatcttttaggagagcattatgattcggataagctaggaccagtactcaaaggcgctctgactggggacctgactcgactaattgcaacattaaaagcttgtggtatcagtgtcactgtaaacgaagctaaaaaactgtacgataacttccaaaaagactacaaagccataatttccaaagctaaaaaagatggcctcgagtgggatcgcaaaaacatcgcaagcttccatagtaggatcaaatcagcatcaggcagtcaacggattttacttagaactcaaatgctctatatggcaacgcaattagcagaatcagatgtttcagaaaaagtctctgcaacaaaaaaacatattagtgaagctaaggatacgattgtagaaatatcgacatccactatttcatcagctgaaataatggctatgcaccttgaccaatcagaagttgatgctctggtttcagatataaaaatgtcaacagtttggaatgatggcgtagagacttctgattatgaagcacttgatcactataaaacaaaaatgaccacatttacgaccaatttggtaacagttgcacaaaatttaacagctcaagatgagcaactagctggtgatattgtcacgaacttatcctaaaatagagagattaaatgaatgtccaaagaattgaaattgcccttgaatgaaatgttgaaagaacaagaaagaatagctattaaggcaatagttgctacagcaaaaagcactattacggatactggaacaaatttaaaagcaactttagagtcagatgcccaagacctaaaaaactatgcatccacctataacgccaatatcacggatggtcttgaaggccagtcagctcaagcagcatctgatttcttgacacaacttccaaaaccagagttagataatccagtcaattaggaggctagtatgatagatacaaaaaaactgcaagaactcgatcaagaatatgatcaaaatctcagaaacatttatcgtaacagagagcaactagaagatgactttcacttgtttatggcaagaacagacagcctaaaagagtctgtctatcaagcaactttaggacaaggttgggaattaccccaagaagctcatgcacacctatataatatggatgataataaggatacattcatatcagaattcaatgaatatatggaaaagcttgaagaaaaggaaatagatcttcgaagagtttataatgatagagtagatgaattgtatcagaaggctaagcaaaacgaagcaaaaaaaggataaaaattttttcaagtaatatatataaatatgaaaaataaagaatcttgcagtaaaatgagtatttatttttcacgacgaacagtcactacaaaatcactaaaatctcaaaattacttggtttttaagttaatgtctaatactcaaaccttgttaaatcaatgtttgttatctttaaaaagtgctcagtagcactcaaaatccattgtcctcacggacatgccggttcgaccccggccgccggtatacttataaagacaaggtttagaaaccttgtctttttctatttttttttaaaatcaataaccataagggtaccatttatagttttatactttttcaattagatattttgctatattatcatgatcccgaaaaagattcttacggttaattcctatattgtctaattctttcataattttcattttgttttgtactttaatagttttatagagataatgagtaaatatttatttaaatactgggagtttatttcacgataaataaaatttttactcaatagatgaacagaaaaagattgtatactattgaaaaatttaattcaactggagattgtttggtgagtttatataaaagattattattgtttcaaattattggattctttgtgaagttattaatggaattactttaaataaaggaggaaaaattattttaaaaagtttgacttgttgcattacttattattccaagaagaagatctattccatgagttagtagatataaagacataagcttgaaaattttcaagcttttttatcttgctatttataacattaagtgatatatttataacataatacatgtgatatatttataacataaacttgggagattttatgaacaataaaaacaaatggactataattttacttatttttactatcatcgtaattgatgttagcttactatttggcgggaatcgtttaagtttaccaatcaaattattaattttattagtaaccagtatagcagaattttgttcgatttttataatgataaaagttccgactcctcaaaaatataagaaagaaccatttggattaaaagcaaaattttattctattgtactctttctctcgactattctttatacaattgggatatggaatgtgacgccagcttccccatacaatgttaaagaatcaattcttggagttggcattttaatacaagtagttttcttcatttattttctattaaaaaaaattaacgaaagtcccgatgaacgcttttatagtaatttagcattgtcagcttctttgatgtttttgatatcaataatgttattaattcttatagctatttaccttaatatatatggaacgttagagttaaaatcaggctacctttatattatggtaggtttattattactaatgtttgctgttacatattactttcttgagggacggagataataatggggaaagaaacaaaaattatcagttctttaaaacaggttagagaagatatcggaatgactcaacaagagttagctattcggataggtgttaggagagaaacaattggtcatttagaaaataacaggtataatccttctctagagatggcacttaaaattgttaagattttcgacatgaagatagaagatatttttcaattaaggaaagaggattaaggtgaaggaagtaatttgttcgttttgtggggaaaagattttataacttataaataaaataaggggtacgcaggattgcttcctcttaataggatattagctactggcctagaagtacatcatgatatttgtagaaattgtggtactattgctagaagttatataaatgacttggagaaattgaaataggtatataaaatatattggttactcaaaaatcactaaaatctcaaaatttcttagtttttaacctgatttccaaaacacaaatcttgttaaatcagtgtttgtttactttaaaaagtgcttggtagcactcaaaatccagtgtcctcacggacgttccggttcgaccccggccgcctgtatactttaaaagataaggtttctagacctcgtcttttttgttttgttagataatttattgtgaaaagttacctaaaattacttatatttgttttttattattgtattttttataatgtagttaataacttttcaaggaggtaatattatggaaattttaattgaaacacacttatttatttactctggaagaaaggaaataaaaattgaataaattttttttagaatcagagagacttattataaggccactagaagaaagtgattatgatagttggtatactagttttatgaatcgtggaccatctttaactccatttgatgatgggatacttgatatgtctatgtgtgacattaattggtttaaaaatttagtaaatttacaaaggaaagaatgggaaagtgacatagtatatatatttggtgtttttctaaaaagcggtgagcacgtaggaatgttaaatattgttacccttgcaagagcagatatgcaatggggagaattgggatatgtttttcataatcaattttggagtaatggctatgcatttgagtcaatcttggcattacttaatagtacttatgaaaaattgggttttcatcatattgaagcacagattactcctgggaatgaacgatcggaaaagttggttagaagattgggattaacctatgagacaactcgaaaagatttttcatttgagaatggaaaatggacagataaactgatttatagtataaatttacataataataatttagaataattttatagacttacaaagaaatttaaagcttataatattgtatttttggagattattgaagtggtttatagataattaaggaaggaatattgattagaaatgaataatttggatacactatattgtaaattagcaatgtgcaacacagtactaacggaaagattacgactccagcctgttgaattaactaatgtaaatgattttttagaattttcatctgattctgaaacagtattctatatgcaacgttataaagctaataccgtagaagaagcacaagtcgttttagcaaatgtttgtatgaaatcaccattaggaatttatgcaatgattgaaaaagaatcacagaagatgataggtattattgaattagaaatcagagatgaattttctgcagaatttggttatattttaaataaaaattataatggaaaaggttatatgacagaagcttgttcaaaattgatgtcaattggatttgaacatctagacttggaaagaatttatgctagatttgacattaataataaaaaatctggaaatgttatggaacggataggtatgaaaaaagaaggcgagcttcgtcatcttgcaaaaaatccaaaaggtgagtggaaaacaagagcgtattattctattttaaaagaagaatattttaataaagttaatactaaatagtctgagatgtagagaattagatataatctttttaatcagccagtgggtgatgtcgttgaaaattttacggaaggtaaaaatccgaagattgatacacttaatgggaaaacagttagaatagaaaaaataaatccagatcattttgaagacttatttcaagtttatggagaattgtctactgaagatagtttaacttatatatcttttagcaaatttaatagtaagaatgaatttgatgtctttttccaaactctattaaaatcagaagatccttattatttagctattgttgataataatactggtaaagtattagggactttttcattaatgcgtattgatacaaaaaatagagttgttgaaatgggatgggtggtttattcatcaaaactaaaacaaacaaggatagcaacagaagctcaatatttggttatgaaatatgtttttgaagaactctgttaccgccgttatgagtggaaatgtgatagtttgaatgcaccatctaataattctgcaaaacgacttggttttacttttgaaggaacttttagacaagctgtcgtatataagggtcgtaacagagatacaaattggtattctattttagataaagagtggccagagaaaaaaacacggtttgaaaaatggctagatgattcaaactttgctgtaaatgggtatcaaatcagatcactatcaagcattgagcagaagacaaaatagagtcattcattaatcactaaaatttcaaaattacatgtttttttagctaacatcttaaactttgttaaataaatgtttattaacttttaaaggtgcatggtaggactcaaaatcgggtgtcctcacggacgtgccagctcgactttggtcgcgggcatcaaagaaaaaagtcaagattattatcttgtctttttttctatgagttattaactgtaaaagttacataaaattaccaaataaattttttaacaattaattatcattctttatctaatttataatagggcttatattctatgtttgcccctatacttgaagcatgtacccattctttttctttaagttgtttaaagttttcggctttacctgttaatattattcccgaaaattttaatttgtcgctattatttaccttgtcgtattttttggcatacttttctaaatctgagtagatatttatattattaaagtatacttttgagttaccttttaagttttcttttattttatctatgaatatttgtggtgtattcaaagtttcaggatctgtaccgaattgatactttgttggccaatatgatgtatctaattctgtgcttgtacctatccataaccaattttgttttatattatttggtatcattgtttttatttctttgtaactataggacttatcaaaagttattgcaatttcaataagatcattattcaatttatttacatattttaaatcatttgttggagttgttttggcttctccttttttatacttaacatttttattgaaaaattgtggaactttttgtctagtacctcgatcatacaagccattcttttctgatttttcatcagcatttgtgccaaaagtacctgagatactataattttcttcaaaactagaatatggaatttgaaccccatcgatatctttaaatctatcagcatgtactttaccagtaaactgaccgcttggctggtaatagagactatcataggaaatatttggatatgctatttcagaaagtagttcaaagttatgatatgttttttgaccattttttgaagttaaatatgtaaaccctttaaaagctattccaactactaatagtacagttattaatgccaatactacggtcttgaataatgttttccttttcctttttttggctaattgttccagtggatcactaaactttgtttttatcatattttaaaattatccttttctaaatattttttaacttctcttctagctcgcataagtcttattttaattgtactttgtgattgtccagtaatttcagatatttctttaattgaaaaatcattaaaataatataaatctattaaagtttgataatctttcttcaagtgtaatattgcttcatgtaattcaaaaaacttctctgattcggtgtaatacaaattattttctataaagaattctttttgcaggatttcgttatagcgtttatttcttcgataaagatcaatatacctcctaattgtagtacgatacatccaagcttttattttatcaagtggaagggagaaatcagattctagtatttgtaaaaagacgtcttgagtaacatcctgtgcttgactaggattaacacctgacttaataaggtaagctattatttgatgtgaaataactagtaattctttttcatagtcatctaaaattgacattttacctcctttcgctattatattaaaccctcttcattaatataacgaattaaagagagctttggttacataaaaaaataatttatatatattaaaaatcaggtgatggtaaaaattaaagataaaataataaacttgtttttagttcatatgttagttctaaataataatataaaatcgtaaaaattttgttagactaacattggttttaaaatcttgtaaaaaataattatttttattaggtacttgacataagaagtagtttttaagaaaagagagcatgatgaaaaaatatataaaatggttaattcccatatctattattgggatgttactagtaggctgtcaaatgaataggggacctaaaagtcagtcaaacgaagtaaaaaatagcaagcaatcagaagtgaagaaaggtaaaaatatgataaaaaagaacagttagcctacctaaagaacatgaacaagaaataatggtgaattatttaaatgtatcttttgatagagtagagtatacgatggtatttttaatgagatgtagagtagattgaatgctttctttaaatttagaagtattatctagctcagtaattttaatatttgtttttctatttgttttagttcttcctctagattttcaggctttatattaaggatatataattgaataaagaaagtaatgaactgtccgattactgctcgaagtatttccattttattcaacgaatttccttcacttaaacagttgaaaattttagtaatgtttggatcagttgaatttattagcttagtaaaaatagttgatgtttcactattgattaataattcttgcatcaatattttaatgagatcattatttttttcaataaatttaaaacggtcctgtacaaagaaatgaattagttcctctttagtagaaaatgtagataattctgtaaagaaggggcgtccaatagtttgtacgattaactcgagaataaagaccaaaagcttgtctttagtttcaaaatatttatatatagttgcttggctaacttctgcatttttagctagttgagcagtggaagttccatggaagccttgtgaggcaaagagctctatagcggataaaataactttttgttttccttttggcatctcttggtcattaatatactgttcaatagaaaaaataatattatttttcatacttagttccttttcaaatggtattatactttacggtatcgttttagtccaaagatatttgcgatggttaaaataattaaaaatagaagaagtaccagaagatttgaagaaacgttaggtaatccttgaccgtacataattatttttgtaagtgcatcaccagagtaggagagcggtagaattttaccgactgtctgagcccaacttgccatattttctagagggattattcctgaaaagaataattgaggcattataattaagggaataaattgcatcatttgaaattctgattttgctagagtagacattaagattcctaatgataaggcaaccagagccaaaataaaattgacaatgatgacactaaaaatactacctacaacttgaatatctagtagccaaatagttgataaaacgataactatcgtttgaataattgctagaatgccgtatgataacatatatccaaatacaatatcactacgtttaacaggagttgcaaggagtcgatcaagtgtaccagaagtacgctcttttaataaagccattccagaaattaaaaaaacaaagaagaagaccataaatcccattagtattggtatcatttttgcaaaaaagcctgtatttttatttccgtaattatatttttctttgatatatttggagcgagtttgtaaggattgtgctagtttcggattcttattagctaaaattttaacttgcgaaatcagttccttactgttcattgtattaacagcggttttaaaagcttgtcttgttaaagtcgtctttgaagaatctgtattcgcatagaagacagtataagatttattgtcctccgaaataagagcatcaattttatttgatttgagtgcttttttagcagatgagttaaatttaaatgatctcacttgaatatgcttaatattatctaaatttgaaacgaccttcgtgttaacgttaatagttccaatcttaacttttgtattactattcgcagaaaacataacattcatcaaaaacataattaaaataggtgctaaaaacatcatagcaagtgttcttttatcacgaaacagttcttttataaccttttcagttattgcaataattctcatgattattctccttcagcttttaagaaaacttcctcaatagtactcacattaaattgtttttttaaatgtaatggagtatcaaaggcaataatgtttccacgtaatagtagtgcaaccttacttgttaattctgcttcatccataacgtgggttgtaataaagatagaatgtccttcatccttaatattaattagctcttgccagatttttctcctcaaggatggatcaattccaacggtaggttcatctaggattaaaactgtggggtttccaagtagggcgatggctagagaaagccgtcttttcatacctcctgagtaacctgagacaaatttatcaagttggttttctagatctactactttagaaatatgagttatctgctgttttaattcagttttttgaatacctttcatttttccaaagaataataaattttctaagccagttaaagactcgtataaggcatcagattgagccatatagccaatttgatttaaaatattacgatctggcatttgagtatcaagaacaagagctgttcccttatctgctttttccatgccaagcatagttttaatcaaggtagatttccctgctccagagggtcctattaatccaattatttcgcctttaaacacctccaaattaatattatttaaaacggtttctgaggcatatgctttttgtagtttttttaaatcgatgacttttttcatgataactttttgctcctctctcagtgagtgagtgtttactcacttatttgatatcatatattatagtgtgtaaagacaggcttgtcaataaaagaattgacaggaagttaatataccataatagtcaataaaatggcttatttgagataactaattttttatcttaaaaatcagttgcatggagagcattcgtgaaaatgggcacagaataaaacgactaagaatatccttgtcgttttattttttatatagttatacctcttttaaaattcaatataatagacttcctgcgaaactaaaatcctagttcacggttgatcattccagcaatcaaattcattcgtaatccaaaccgtttgcgtcgatttcgataggttgttgaaaatattttaaacgtttttactttggcaaaaatattctcaaccttgattctctctttggatagcgtatggttataggttttatcttcaagagttagtggcttaagtttgcttgatttcctcggagtttgcgcttgtgaatacatcttcatgatcccttgataaccactgtctgccaagattttagcagcttgtccgatgtttctgcgactcattttgaacaacttcatatcgtggcaatagttcactgcaatatccaaagaaacaattctcccttggcttgtgacaatcgcctgagccttcatagcatgacatttctttttaccagaataattcgctagttgatttttttaggacgattgatttttacctctgttgcatccacaatcaccgtatcctcagcactaagatgagtttttgaaatcgtaaaaccactttgaataagagttgattcaacccattgacttcgacggattaagttgctttcgtgaatgccaaaatcagccgcaatttgttcataagtgcggtattctcgcatgtattgaagagtagccatgaggagatcttctaagcttaacttaggggttcggccaccttttgcgtgtttacgttgataagctgtttttaacacagctaacatctcttcaaaagtagtgcgctgaacaccaacaaggcgcttaaatcgtacatcagttaattgtttgcttgcttcataattcatagaactattgtaccatattttgtttcgcaggaagtctaataatgtttattcaggtattttttaacaatgatatgaagagagaagctaagtcccagtataattaaataaatccaaagggggatattaatgaaaggaagatgataatattttcctataaggatataagctatgataagcgaaagaattagaaatatatatcgaaagaaatatttcttttctttcgatttatcgaagttatatgtagcatatattatggtatcagctatcttgacagcaataatactgataaagattgcaaaaagaacatctaatagagtaatagggattagatctggtactgactgttgaagtgcttcagtaatgagatatcctcctaaaaagataatcatttggatagttagtagtaaaatggctaaatcccaacgttgtaatgtttcttctttcttagagattttaggtgtagatttaataacttggtttataaagtcatgcctatcttctccaaatacactaactaaacttgcttgtcgctcttgtgcttctaataacatattgacaatatcatttcgaatgagctcctgatggtaggggctaatgctagcacctcgcaaatagacaatcatatctgtataggtttggttattagagttatcaattcttccttctaatagcgtattttctttttgtaattttttcagtttatccatgctagtttcctctccaatttttagagtagtttgtttaatgctttactaagtgactcccaattctgtttaaattgggctaattgctccacgccttcattggttaacgtataatatttacgcttaggtccttgaggggaaggcttttgttgtccttttatatatttattgctttgtagtcttaagataatggggtagattgtcccttcggaaatttctccaaaaccataagaatttaatttttttgagatttcataagcataagtctcctcttgctgtatgatttttaggatagctccttcaagtaatccttttagcatttgcgatggaatcatattatatccttgtctatattgtaatacaagttactggtatagctacattgtaatacaaagtagttgagatgtcaaatataactaagttaccggtagaaaataagagtgatagacgatgattcttctaaaataggtttgtttatgtcctttagtttatgttataataatgtgaagaaactttaggagtgagtatgaaaatagataaaaaagaacttttagcacttattgctagtattattttattaatttttgcttctgttacgtttttcttatttaaagatcatggcactactcaaatggatactgtagaaagcagtgttaaccatgtcagtgattctcaattaactgaggcacaagatatgttagataaatttgagaagaaaccttcagaaaaattattgaaggatgtcgaacttgctttaaataaattgtccaattcttctaaaaaagaagctttgcaaaaacgttttaagaaagcaaaagataagtatcttaaagacgaagcagataagaaagctaccaaagatgctacagatttagtagaaattctagaacaagccccttcagaagaaaatgtgttaaaagctgaagcagcagtcaataagttaactgtcaaagaatctaaagaagctttacaaaaacgtattgatactgttaagacacaatatggtttgattgggaatcaaactccctctagttcagtagctgaaactacagaacaagggacagctaatcctgctagtcaggatacttctagttacgttaatcagaatgtagcaccaacttatgagcaaccgcaagcgaataatacaccagttactccaggggttaacaatactgttccgactccaggaactggtactgtacctgctactaatgggacaggtgttgctcagtaaaatcctgaaagtctagttttactagacttttttgctatgctttttaattagccattctcatcaaaaactataagagaattagcaattgatagttttgaagaaggaaaagaattatgagcaacagcaattaaaaccttaaaaatacaaccaagtgaagtggtttataacaagtgtacagttctttcttagaataaaccatgacttgtcaaaaaataggtatataccatttacaaaaataccttaaagcgttataatgagagtgaatggggggaagaagatgacgaagtacatcaaggctgaccgattcttttatgctgatcatgtaaaggaaaacggttatttagaaataaaagataatcactttggtaaatggatagaaaatatttctggacaagaggagattttagattattcaggttatcaaatagcacctggtttagttgatacacatattcatggttttgctggcgctgatgttatggattgtgattcagaaggaattttgcgaatgagtgctggcttactatctactggagtcacatctttcttgccgacaaccctaacttcagatacaaagcgactagaagaggcgtctaaatcagttgcggcagtagcgggcaaagaacaaggagcaaaaattcaaggcatctattttgagggaccatattttactgaggaatataaaggagctcaaaatccgatttatatgagaaatccaaacttggaagagtttgctcaatggcagaaggctgcaaaaggcttgattacaaaaattgctttggcaccagaacgtgagggagttgaggaatttgtctcagcaatcacaaagcaaggtgttacggtagctttaggtcattctaatgggacatataaagaagctaaaaaggcagtgaaggcgggtgcctcagtttgggtacatgcgtataatggtatgcgtggtttgacacaccgagaaccaggtatggttggtgcggtttataatttacctaatacctatgccgaactcatttgcgatggtcatcacgttgatcctgttgcttgtgacattttaatgacacaaaaaggccataatcatgtggcattaataacagattgtatggcagctggaggtgcccctgatggagattatatgttaggggaattgcccgtggttgtgtctaatggaactgcgcgtttgaaagatggaggtaatttagctggttctattcttaagctcaaagatggattaaaaaatgttgtagaatggggaattgctactccggaagaggcagtgcgtatggcgagttatgttccggcagtgtctgtaggcattgataatgtctgtggacagataaaagaaggttatgcagcggattttattgtattagataaacatctagatttagttgcaacataccttgatggggaaaaacgttggcaatcttgaaagaactagtttttactagttctttttaatttattaatttttaatgaaatatagtttgacaataaaactattttttcttataatgttgtaatataatacaaaacaataggagtttacaatgtcaattattattgggttaatggccgctatgtttattattcgtttagcttatttaaagctatctatagctaatgaaaaggccttaagaaaaaatggtgctaaagaatatggtgtaggtgtttcaaaagcaatcacagttcttcatattatcatttatttttcatctgtaactgaggctattctaacaaaagcaagttttaattttgttagcgtaatcgggcttagcttgatgattttttctgtgtttatgttacatacagtaacacgtttacttggtcgtatttggacagtgaaattaatggtagataaaaatcatcaatttgtagatcactggttatttagggttgttaagcatcctaactatttcttaaatattgctcctgaacttttaggtgtaactttattgtgtcatgctaaatacacagcattatttgtcttgccaatttatgcttttgttatttatttaagaattcgtgaagaaaacttattattaaaaacgatcattattccaaatggaatcaaaaagtctagggtatattaagaataagataaatagtagacataaaagtcattttttgttatactgtctcagtaagaagaggtgttcatcagctgtttttttagcgagctcaaggtagtgaaagttgggtagaataggatgaatattggcactttttagtgagtaaaagtacaatcaaaaatgaagtaataaattagggtggaaccgcgtctttgacgcccctgtgctgttgggcataggtggtgtaggacgtggtttttatcatttgtccgttttaagtcaattgttgtcaccttcccaacagctgtaataaagtgtgaaagaaggaaaatgatgtctaagaaattaacttttcaagaaattattctaactttacaacagttttggaatgaccaaggctgtatgttaatgcaagcttatgataatgagaaaggagcagggacaatgagcccttatactttcttacgtgctataggccctgagccttggaatgctgcatacgttgaaccatcacgtcgtccagctgacggccgctatggcgaaaatccaaaccgtctttaccaacatcatcaatttcaagtggtaatgaagccttcgccgtcaaatattcaagaactttatttgaagtctttggaattactaggtatcaatccacttgagcatgatatccgttttgttgaagataactgggaaaatccatctacaggttcagctggattaggttgggaagtttggcttgatggaatggaaataacacaatttacttatttccaacaagtaggtggacttcaaacaggtcctgtaacttctgaagttacttatggactagagcgtttagcctcttatattcaagaggtagattctgtttatgatattgagtgggcaccaggtgttaaatatggtgaaatctttactcagccagagtatgagcattcaaaatattcatttgagatatcagaccaagtaatgttacttgaaaactttgagaaatttgaaagagaagcaaaacgtgctttagaagaaggacttgttcatccagcttatgactacgtccttaaatgttcacacacctttaatttattagatgcacgtggagcagtatctgttactgagcgtgcaggctatattgcacgtatccggaatttagcacgtgttgttgctaaaacctttgttgccgaacgtaaaaaacttggtttcccacttttggatgaggaaactcgtatcaaattacttgctgaggaagactaatgaacacactcattgttaatagtcatcctgatttttcgaatccgtactcatttacaactattctacaagaaaagtttattgaactttataatgagcattttcctaaccatcagttatctattttaaatttatatgattgtgttttgccagaaattacgaaagaagtactactttcgatttggtctaaacaaagaaagggtttggaattaacagccgatgagattgttcaagctaaaatctctaaagatttacttgaacagtttaagtcacatcaccgtattgtctttgtttctccaatgcacaattacaatgtgactgctagagcaaaaacttatattgataatatttttattgcaggtgagactttcaagtacactgaaaatggttcagtcggattaatgacagatgactatcgtctgcttatgttagaatctgcgggttctatttattctaaaggacagtatagtccatatgaatttcctgttcattatttaaaagctatctttaaagattttatggcttttgatgatttctgtgttgttcgtgcagaaggtaccgatattttagataggcaagttgttcttgataagatgaatcaggatttaagagaagcatttgaagcgttttacagtaaggagtaggaaatgactaaagatttattattggagcttggccttgaagagttgccagcttatgttgtgacaccgagtgagaagcaattgggccaaaaaatggtcaagtttttagaggatcatcgtttatcatttgaaactgttcaaattttttcaactccacgtcgtttggctgttcgtgtgaaaggattggcagaccagcagacagatttaacagaagatttcaagggtccttctaagaaaattgctttggatgcagaagggaatttttctaaagcagcccaaggttttgttcgcggaaaaggtttaagtgttgatgatatcgaatttcgtgaagttaagggagaagaatatgtttatgtcactaagcatgaaactggaaaaagtgcgattgatgttttagcgagtgtgacagaggtattaacagaattgactttcccagtgaacatgcattgggcaaataatagttttgaatatattcgtccagttcacactttagtggtattattagatgatcaagccttagagctagacttccttgatattcattcagggcgtattagtcgaggacaccgtttcttgggttctgacactgaaatttcatctgccagttcgtatgaagatgacttgcgacaacaatttgttattgctgatgcaaaagaacgccagcaaatgattgttaatcaaattcatgctatcgaagaaaagaaaaatatttcagttgaaattgacgaagatttactaaatgaagtgcttaatttagttgagtatccgacagcattcttgggttcttttgacgagaaataccttgatgtacctgaagaagttttagtcacttcaatgaaaaatcatcaacgctattttgttgttcgcgacagggatggaaaattgttaccaaactttatttctgtgcgtaatggaaatgctgagcatatcgaaaatgttataaaaggtaatgaaaaagttttagtggctcgtcttgaagatggtgaattcttctggcaagaagatcagaaacttaatattgcagatttagttgagaaattaaaacaagtaactttccatgaaaaaattggttcactttatgaacatatggatcgtgtaaaagttatttcacaatatttggctgagaaggcagatctttctgatgaagaaaaattagctgtgcttcgagctgcaagtatttataaatttgacctcttaactggaatggttgatgagtttgatgaattacaaggtattatgggtgagaaatatgccttacttgcaggggaacagcccgcagtagcagcagcgatacgtgaacattatatgccgacatctgcagatggagagcttccagaaaccagagttggtgcaattctagctttagctgataaatttgacaccttactttcattcttctcagttggtttgattccaagtggttcaaatgatccatatgctcttcgtcgagctactcaggggattgtccgtattttggaagcttttggttgggatatcccacttgatgaattagtaactaacctttatggtctatcgtttgctagtttagattatgctaatcaaaaagaggtcatggcctttatttcagctcgtattgaaaagatgattggctctaaggtccctaaagatattcgagaagccgttttagaatcagacacttatattgttagccttattctagaagctagtcaagcattggtgcaaaagagcaaggatgctcaatataaagtttccgttgaaagtttgtcacgtgcatttaatttagctgaaaaagttactcattctgtattggtggactcttcattgtttgaaaataatcaagagaaggcgctatatcaagctattttgtcacttgaactgactgaggatatgcatgacaacttagataagcttttcgcacttagtccaattattaatgatttctttgataatacaatggtaatgacagatgatgaaaaaatgaaacaaaatcgtctggctatactcaatagccttgttgcaaaggcaagaacagtcgctgcttttaacttattaaacacaaaataaggaggcattttatggatcctaaaaaaattgctcgtattaacgagctttcaaaaaagaaaaaaacagttggattgaccggagaagagaaggttgaacaagcaaagctccgtgaagagtatattgaaggtttccgccgatcagtccgtcaccacgttgaaggaattaaattagtggatgatgagggcaatgatgttaccccggaaaaacttcgtcaagtccagagagaaaaaggactacatggtcgtagtttggatgatccaaattcttaatggtgagacaattttagattaaagtcaacacttgggtggggcaaaagataatctttgtctcgccttttttattaggaaggaaaaaataatgattgaattactattagcattactgttatggaatattttagtatttgcaacctatgctattgataaaaggcgtgcaattagaggggcatggcgtattagtgagaaaacattgatgatagagagtttattattagggggatttggtgcattcctaggtggagaagtttttcgtcataaaacgactaaatggtatttcagactagtttggtatatcggaatgattattgatttagctattatttggctaatttggtgttattgatgatatcttatcaaaaattttaggagcatattaaatttttgatagtgcaggatagactgatttaggtataatagaattacaaaaagaaaacgcttacttttaaggaggaagtttatgtcttcagaagaaaaatacattatggcgattgaccagggaacaacaagctctcgagcaattatttttaataaaaaaggtgaaaaaattgcgagtagccaaaaagaatttccccaaatttttcctcaagcaggctgggtagagcataatgctaatcagatttggaattctgttcaatctgtcattgctggagcttttattgaatcaagcatcaaacctggacagatagaggctattgggattaccaatcaacgtgaaacaactgttgtttgggataaaaaaacaggtcttccaatttataatgctattgtatggcaatcgcgacaaacagccccgattgctgatcaattgaagcaagaaggtcatactaacatgattcatgaaaaaactggtcttgtcattgatgcttacttctcagcaacaaaagttcgttggattttagaccacgttcctggagcacaggaacgtgctgaaaaaggagagttgctttttggaacaattgatacttggttagtttggaagttaactgatggtctcgtccatgttacagactattcaaatgctgctcgtacgatgctttataatattaaagaacttaaatgggatgatgaaattttagagttactaaatattcctaaagcaatgttaccagaagtaaaatctaattctgaagtttatgggaaaactactccattccatttttacggtggagaggtgccaatttctggtatggctggtgaccaacaggcagcattatttggacagttggcctttgaacctggtatggtaaaaaacacttatggtacaggttccttcattatcatgaatacgggcgaagagatgcaactgtctcaaaataatctattaacaacgattggttacggcattaatggtaaggttcattatgcacttgaaggatcaatcttcattgcaggaagcgctattcaatggttacgtgatggtcttagaatgattgaaacgtcaagtgagtcagaaggccttgctcaatcatcaacaagtgacgatgaggtttatgtggttccagcttttacaggtttgggtgcaccgtattgggattcaaatgctagagggtcagtatttggattaactcgtgggacaagtaaagaagattttgttaaagctacacttcagtcaattgcttatcaagtacgagacgttattgacactatgcaagttgattcaggaattgatatccaacaacttcgtgtagatggtggagctgcaatgaataatttattaatgcaattccaagcggatattttagggattgatattgctcgtgcgaagaaccttgaaactactgccttgggtgcagctttcttagccggactttcagttggctattgggaaagtatggatgaactaaaagaactgaacgcaacaggacaacttttccaagcaacaatgaatgagtctcgaaaagaaaaactgtataaagggtggagaaaagctgtcaaagcgacacaagtatttgctcaagaggattaagggggtgtagagatggaattttcacgagaaacacgacgtttagccttacaaagaatgcaagatcgtactctggatttacttatcataggtgggggtatcacaggcgctggtgtcgctttacaagcagcagctagtggattagatactggacttattgaaatgcaagattttgcagaagggacaagtagtcgctcaacaaaattggtccatggtggtcttcgttacttgaagcaatttgatgtagaagttgtttctgatacagtatcagagcgtgcagtcgtgcagcaaattgcaccacacattcctaagccagatccaatgcttttaccggtttacgatgagccgggttctacttttagtatgtttcgccttaaagtggctatggatttatatgatttattagcaggtgtgacaaacacacccgcagccaataaagttttaagcgcagaagatgttcttaagcgtgagcctgatttacaaaaagaaggtttgctaggcggaggggtctatttagatttccgtaataacgatgcacgcctagtgattgaaaatattaaacgcgctaatagggatggagcttatattgccagtcatgtcaaagctgaggacttcttatttgatgacaacaatcaaattataggagtacgtgcgcgtgatttgttgactgaccaagttatcgatataaaagctaggcttgttattaatacaactggaccttggagtgacaccgttcgcaacttctccaatgaaggtaaacaaattcatcaattacgtccaactaagggagttcacttagttgtagatcgccaaaaattaaatatttctcaacctgtttatgttgatacaggcctgaatgatggtcgtatgatttttgttttgccacgtgaagataagacttattttggaactacagatactgattaccatggagacttagaacatcctacggtaactaaagaagatgttgactacctccttaatattgtaaacaaacgcttcccagaagcagagcttactattgatgatattgagagttcatgggcaggtttgcgtccactactatcagggaatagtgcctctgactataatggaggcaatagtggaaaactaagcgatgaaagttttgaagaattaattgattccgttaaagattatattgcacataaaaatcatcgtgaggatgttgaaaaagctatttctcatgtagaatctagtacttctgaaaaagaattggacccatcagctgtttctcgaggatcaagttttgagcgtgatgataatggcctattaacacttgctggtggtaaaattactgattatcgaaaaatggcagaaggtgccatggaaactattattaacattttggataaagaatataatcgcaagtttaaactaatcaattctaaaacctatcctgtttcaggaggagagattaacccatctaatgttgattctgaaattgaagcttatgctcaattgggcacactaagtggtttaagtattgaggatgcacgttatattgctaacctttatgggtcaaatgcaccaaaattatttgcattgacacgccaaattacagaagcagaaggtctgagcttggtagaaacgttgtcacttcactatgctatggattatgaaatggcgcttagcccaacggatttcttcttaagacgtacgaaccatatgcttttcatgagagataatttagattctttgattcagcctgttattgatgagatggctaaacattatcaatggtctgatcaagacaaaactttctatgaagaagaattacatgagactctaaaagacaatgacttggcagctttgaaggataattgaaggagataataatggatatttttggagaattcttaggaacagctctcttagtcttacttggtaatggtgttgtagcaggtgttgttttgcctaaaacgaagaatcataattctggatggattgttatcacatttggatggggacttgctgtagctattgcagcgttggtatctggcaatattagccctgcccacttgaatccagctgtgtcattagcttttgcgatcaaaggtgatttagcttggggaacagctattctttatatgattgcacagattattggtgcaatgctaggttcacttcttgtttatttgcaatttagaccccattatgaggctgcagaaaatagagcagacatccttggaacttttgcaactggtccggctttgaaggataatttttccaattttttaagtgaagtattgggaacacttgttcttgtacttactatttttgccatcggaaaatacaatatgcctccaggagttggtacgatgagtgttggtatgttagtggttgggattggtctatcgctcggtggaacaacaggttatgctattaatcctgcacgtgattttggtcctcgtttattgcatgccttgttaccgatgaagaacaaaggtgattctgattggacttattcatggattccgatagtaggacctatggtaggagctattttagcagccttaatatttgctatgatgtaagagatttttgatgctgagaccgactttatggtctcagttttttgttaccgttttcaaaaataacttcttttgttataataagtaattatgacagaaaaatatgtaaataaagtaattgtcattttaggagcttcttttgctggtatgacttgtgcgcagaaattacgccaattaaatcctaattgggatatcgttttgattgataaagaaattcatccagattatgttccaaatggcttaaattggtattatcgtcacgaaattagtggtttaaatcaggccatgtggcagacagaagaagagcaacggttgcagaatatacgctgtctatttggtctaaaagttgagaaaattaataaagaagatagggaattaatgttatcagatggttcttctgtctattatgatcaattgatttgtgccatgggctcccaagcagaatcaacttatattgatggggctgatgcgcaaggtgttttaacaacaaaaacttatgcaactagtcaaaatgctaagcaggtattagataaaagtcataaggtagcagttgttggggcaggtatcatcggtttagatattgcttatagtttacatgaatcagggaaggcggtcactttgttagaagctcaagaaagaccagacttcaggcatacagatcctgatatgtcccttcctttacttgatgcgatggctgaatcaaaactacattttttccaaaatcaaaaggttgagaaaattactgtaacccgagaagaaaaactttgtttgcgaacgctaacaggagacacctttacagttgatgctgtcatattagctgttaattttcgtccggatagtcgtcttttaactgggttggttgatttaagtgttgataatagtgttgttgtaaatgattatttccaaacgagtgaccctaatatctatgctattggcgatttgatttggtcgtattttaaaggtcttaatagtgcttattatatgcccttaattaaccaagcaatccgttcggcacaaatgttggcataccatttatcgggacatgctgttccaaaattaaaaataacacgcgctacaggatctaaacactttggctattatagagctaacattggattaactgaattggaagctggtttttacgaggataccgttagtgttacttatttccctaaagaacagtatgatttaaggataaaattgattgctaaccaaaaaacgggccatttattgggggctcaattaatctcaaaggaaaattgtttggctactgccaatcagcttgttcaagctatatcgtgtgatatgacagattttgatctggcttttcaagatttcatttatacagctagagaatctgagatggcttatatgttgcatcaagcagctatcaacctttatgaaaagaggattgggctatgcgaatagaagctctaatggaaaaagaaaggcgtgttcaatatcggctactttcttttttaagaggctctcctcaggcaatagcactgaagttagctttattagaaactggtttaagtcgagcaacttttcttaaatatatcaataatcttaatagctactttgaacaagaaaaagttaattgtcgaatcgtttattataaggataagttatttttagaagaggattataacttatccaatcaagaagtgttgaaagctctgatgaaagatagtattaaatacactatcttaatatctttatttaatcagcgtcagttcacaatcgttggtctttctcaagaattgatggttagtgaggctactttaaatcgtcatcttgctcatctcaatgaattgttagcggaatttgatattgctatttcacaaggaaaacagattggtgatgaattgcaatggcgttatttttattatgaattattcaagcaactatggtcttatgacaagtgccaaaatatgataaagaaattagacttagactcattaattctattaatagagcgcttggctcaacatactttaactcgagaagctcatcaaaatctgggactttggtttagtatttgtcatcatcgtctccttgctatggaaaaaatatctgataatctcaagcctattgtgaaacattatcaatgtaatgctttttataaacggttagacgcagccttagttttgtatatgagtcgttttgctcttgagtatagggaaggagaagttctggcaacttttgcttttctacattcacaaaatattttaccaatcaatacaatggaatacatcatgggatttggaggcccgattattgattgtgtaaccgaaacaatcatctactttaaaaaggagagtattttagctgacgagacatcagatcaggttatttaccaacttggtcagttatatagccattattatttctttaaaggtcatattttagttgaacaacctgatttagaacaaacgtatcgacttattgatcataatatgagggataagttgcatcatatttcaaagaagattattgcaaatgttaatcgaattagacctttaacagaagatggttgttctttgctgactttacatttgttggaattgcttattttctcgaaaaatagtcaaaaaatgccctttaggattggtctagatatgacaggtaatgctgtggaacagtcattgttggaatatcgcattcgacaacatttctctggtaataattctattcaagtcgaaccttatgacgaaggaaagggatttgatatggttatttatcagagtcactcaagaccttataaagccaaactaacctattgccttaataaaggtgcttcagagcgagaactacaggaaatagattcacttatttatgacaattaatcccattacttaattgaatggttttaatccctccagaaattgttaaaacgtttacgtattttatgttataatatcaaagacgaacaattttaaatttagttgttaaaaacagaaaggttttatcatgacatttgacaccattgatcaattagcggttaatacagtccgcacgctttctattgatgctatccaagcagcaaattctgggcacccaggtcttcctatgggagctgcgcctatggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaatttcgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacatctcaatcatttacagaagatgttaaaggacgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatgtatgggaatatccagactttactgttcctgctgaagttgcagatcgatttgcctcagatcttcaagcgcgtggtgcgaaggcagaagaggcatggaatgatctttttgctaaatatgaagttgagtatccagaattagcaactgaatacaaagaagcttttgctggccaagctgagacagttgaactgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaactacgctgggcgtaatatttggtttggtgtacgtgaatttgcaatggctgctgcaatgaatggaattgcgcttcacggtgggactcgtgtttatgggggtacgttctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactttaagagcatgaagaagttgggaaagatacctcaacttcttttttgtaagatataggatggatttgagaatagttttgatagactgataagtgatggaaagcactcttttttgaaaacgtttgacaaacattccatagcgcagtataattgataaaactattgtatatataaaataatacaactattattaattatctttttagaaaggtttgtttatgaagaaggagtgtcgtgatttttatcggcagatacagcatacttacaatgatatatctgtccgtgaagatgcagtgctatcatcaatactattatcagcatcgaatggtttgataaaaactagcgatgtacctcgtgttgcttatgagttaactcagcaattggaaaataatgagatagaaaaatctttcgagtcattagctacagttaaggaattgaaaaaatctgctaaaaaattgtctgagagatatgagcaaaataaggtaacaacgggattgctttctaaagtatttggaaatcattaggagataaaaggagatttttatgattaagtttgaacatgtttcgaaagtatacggagaaaaagaagctctcagtgatttaaccctctctgttaaagatggtgagatttttggattaataggtcacaatggagcaggaaaaacaacgacaattagtattctaacatctattattgatgcaacttatggccaagtctatattgatgacctacttttgacagaacatcgtgaccaaattaagaaaaaaataggttatgtaccggactcgccagatattttcttaaatttaaccgcagaggaatactggtactttttagctaaaatttatgacgttgccccagaagatattgaagcacgtatcacaaaattggtagacatatttgaactagaggagcaacgctataatcctattgaaagtttttcacatggtatgcgtcaaaaagtcattgttataggtgcccttcttccaaatcctgacatttggattctagatgagccgttaactggtttagaccctcaagcttcttttgatttgaaagaaatgatgaaagaacatgctaaaaatggaaaaacagttattttttcaacacatgtcttagcagttgcagaacagttatgcgacagaataggtattttgaaacaagggaaattaatctttgtcggtagcttaggtgagttaaaaatgaaatatccagataaagatttggaaactatctatttggaattagcaggacgtcaagctagtagggagggataaagtatgaattggtcacgtatctgggaactcgtaaaaattaatatcctttattcaaaccctcagactctatcggcactaagaaaaaagcaagaaaaacatcctaaaaaagaattttcagcttataaatccatgtttagaaatcagttatttcagattttgctcttttcaataatttatgtatttctctttgtatcacttgattttaaagaatatccgggctacttcacgttctacattggtatctttacactagtatccattatctactcttttattgcgatgtacagtgttttctatgagagtgacgatgttaaacaatatgcttatttgcctattaaatctgaagagctctatgttgctaaaatttttgcaacatttgggatgtctgtaacttttctaatgccaatcctaaccttaatgattgtggcttattggcgtataataggtggcccacttgcggtcctcctagcaatcataaattttgctattttatttttatcggtaacggtgatttcattgtatattaatagtttaataggccgtgccattattcgaagtgctaatcggaaacttatttctactatattaatttcactagctacatttggagcaatagttcccttattatttgtgaatatgacgagtcaaaagatggtacaagggaaattacaagatatcgctccaatcccttatgtcagaggttattatgatattgttacagcgccatttagtatggagagtctcctcaactattatctcccgctcttaatcattttattcttgataggtgctatttataaatgggttatgccacgctactatcaggagttgttgtatggacaggtcaagcagagaaaagtccatcgtcaaatcgattttagtaaacgtgagtcaattaataaaactcttgttaaacaccatttatcaagtttacaaaatgcgacattattgacaaatacatttttaatgccactattatatctagcaatgttcattgttccaattttgaataatggtaaagagattggtcgattttttaatgaaaattattttgggatagcttttctagcaggaatattaataggtagtttatgtgtgatgccagctagcattgtaggggtaggtatttctttagaaaaaagtaatttctactttataaaaagtttgcctatatcattttcgtatttcttgaagcataaatttgtaactttgataaccttacaacttgcagttcctacttttatttatttcttggtaggattctttctacttaaactatcaatcctcgttttattgagcttcattttaggtctagtcttcatgggacttatcgaaggccagtttatttatagacgtgactataaacatttgttcttgaattggcaagaggttacgcaactatttaatagagggttaggccaatggctgttagttggttcattgtttggaatgatgataataggtagttttcttattggaataagtattttttggtcaatggtatggaatactgtagctgtcaatatcataatccttatcattgggttgctcatattatcaatttgccaatacttactgctaaaaaatttttggaagaagcttgtttagtaaaaaggttttagaaaaatcatacagtaagaataatgcttaataactgagatagttatagcggataaaataaaggcttgttgtggactttacggttggaaggcagccactgtaatcctttgtttaataacgctagttttagctctaaaatatttgatttttattgctatctattatatcttatcagacaaagagactagggataacctagtctctttgtctgatgctaacttgtttttcgtaatattgtgctagaatgaatgtcaatatagcagttgtgcttacagtaatgataactgcaataagcatggtaataaaaagatgtgttgaagtatgactgatataaagaaacagacctggtagaccagaagagcctacagcgaagcggtgagcgttcattataccggcatagagtcctccaagaccaccaccaataagtgaggctattagaggataacgtttcggaaggttgacaccatataagataggttcggtgattcccatataagctgttatggcagcaggtccagcaatttctttaagttttttttcttttgttataagagtcaccactgtacctgcagttgcttgtgcgatatttgagcagagcatgcctggtccaaaaatagaatcaacccctaatttcgctagttgtgtgattcctaatgcagcaattccactatgaacaccaaacatgattaggataggagcaaatgctcctactagaaaagcaggtgcccaactggcgtatttggataaaaaagtaaaaataacagctaaatattggccagcgatagtacccattggtcccaatatagagaacgacaaaattcccatgctgagaaatattaacataggaacaagcactaaacgcagtgatttaggaataatttgctttaaatatttttctatataagcctgaacacaaataattagaataatgggaatgacacttgatgcatagttagtaagtgtgaatgggatcgtatggaataaggatactggtttaccagaagctactaaattagcccaattagggtgaaggagcatgacaacagttcccaaagctaaaataggattagctttcaatttttgagcagctgtgatggcgattaagataggtaaaaaatagaaaacaccatctgcaaaaagatttagtaatatatatgtttgagatgacggtgtcaagattttgaatactagtaataaagctagcaatgccttaatcataccagcgcctgataaagcaggtaaaatcggttggaaagtcccagaaacaaaatcaataattcgactaactgctttggcttttttggtttgttctattttagtcgttgagttagtttcaatgagggagttaatttcttcaaacacttttgcgacatgagtccctatcactatctgatgttgccctccgctgataacgacagtttttacctcttttaaagtttttaattgctcaaggtttactttcgtcggatcattgagactaaagcgaaggcgtgtttgacaatggtaaacattgttaatattattttgtccaccaaggtgtttgatgatattttttgacaaggtgatgtattctctagacataatatctccttaatacttataaaacgttttccgattctagattatagcatagtaataaaagaaaacacttggaaatgcttgtgaattttcaatgatgttttcagatagcatttctaaagggcctatgatataatttttttatgaaaagacattttgagacaactagaagaattgttattaaagtaggaaccagttccctcgtacagacaagcgggaaaattaatttaagtaaaatagaccatttagcatttgttatttctagtcttatgaatagaggcatggaggtgattttagtatcatctggtgctatggggtttggtttagacattttgaaaatggataagcgtcctcaagaaatatcacaacaacaagcagtttctagcgtaggacaagtagccatgatgagtctttattctcagatattttcgcactatcaaactcatgtttcccaaattttattaacacgtgacgttgtggtttttccagagagtttgcaaaatgtaacaaactcttttgagagtctgctctctatgggaattttgccaatcgtcaatgagaatgatgctgtcagcgtggatgagatggatcataaaacgaagtttggggataatgaccgtctctctgctgtcgttgctaaaattactaaagcagatttattaattatgctgtcagatattgatggtctttttgataaaaatcctaatatttatgatgatgctgttttacgtagtcatgtttctgaaatcaccgatgacatcatcaagtcagctggaggagcaggaagtaaatttggtactgggggcatgcttagtaaaattaaaagtgcacaaatggtgtttgataacaatggacaaatgatattgatgaatggcgccaatcctcgtgatattttaaaggtgttagatgggcataatattggaacttattttgctcaaggaaagtgagattgagttatgacgtatattgaaatattagggcaaaatgctaaaaaagctagtcaatcagtagcacgattaagtacagctagtaaaaatgagatactcagggacttagcgagaaacatagtggctgatactgaaaccattttgactgagaatgctcgcgatgttgttaaggcaaaagataatggtatctcagaaattatggtggaccgtctacgactaaacaaagaccgcatacaggcgatagcaaacggtatttatcaggtagcagatttggcagatccgattggtcaagttgttagtggttatacaaatttagatggtttaaaaatccttaaaaaaagagtgcctttaggggttattgcaatgatatttgaaagtcgtcccaatgtatcggtggatgcctttagtttagcttttaaaacagggaacgctattattttgcgtggtggtaaagatgctattttttcaaatactgccttggttaattgtatgcgccaaacattgcaagatacaggccacaacccagatatagtacaattagttgaagatactagtcacgttgtagcagaggagttaatgcaggcaacagactacgtggacgtcttaattccaagaggtggtgcaaaattaattcaaacggtgaaggaaaagtcaaagattcctgttatcgaaacaggtgttggaaatgttcatatctatattgatgaatttgcagatttagatatggcagctaagattgttattaatgctaaaacccaacgccctagtgtctgtaatgctgccgaagggttagttgttcatcaagctattgctaagggatttttatctcaattggagaaaatgctcaaagaatcgaaccagtcagttgaatttcgtgccgatgaggaagctttgcaacttttagaaaatgctgttgctgcaagtgagtctgattatgctactgaatttttagactatattatgtcagtaaaagtagtagattcttttgaacaagcaattagctggattaataaatacagtagtcatcactcagaagctatcattactaataatatcagtagggcagaaatttttcaggatatggtagatgcagcggcagtttatgttaatgcttcaacacgttttacagatggtttcgtttttggactcggagcagagattggtatttcgactcaaaaattacacgcgcgtggaccgatgggattagaagctttaacaagtacaaaatactatattaatggaactggtcaagtaagggaatagttgacctataataggagagattgcatttatcggtctctcttttacttttctaaagtttaggatttatggtacaattaaagttatgacaaacgattttcatcatattactgtgcttttgcacgagactgtggatatgcttgatattaagccggatggtatctatgtagatgctactttaggtggggcaggacacagcgaatatcttctttcacaattaggcccagatgggcacctttacgcatttgaccaagaccagaaggctattgacaatgctcatatacgtttaaagaaatatgtggataccggtcaagtaacctttatcaaagataatttcagaaatctatcttctaacttaaaagcattaggagtgtcggaaattaatggtatttgttatgatttaggtgtatcaagcccacagctggacgagcgtgaacgcggtttctcatataaacaagacgccccccttgatatgcgaatgaatagagagcagagtcttacagcttatgacgttgtgaacacttatagttatcatgatttagtaaggattttctttaagtatggcgaagataaattttcaaaacaaattgctcgaaaaattgagcaagtacgagctgaaaaaacaatatctacaacaacagaattggctgagattatcaaatcgtctaaatctgccaaagaactgaagaaaaaaggtcatccagctaaacaaatttttcaagctattcgtattgaagtcaatgacgaactaggagctgcagatgaatctatacaacaagcaatggacttattagctgttgatggtcgtatatctgtcatcacttttcattctttagaagatcgtcttactaagcaactttttaaagaagcatcaacagtagaagtacctaaaggtcttccttttataccagatgatttacaacctaagatggagctcgttaatcgtaaacccatcttaccaagtcaagaagaactagaagcgaacaatcgtgcccattcagcgaaattgagagtagcgcgtcgtattcgataataagaaagaaacttatgacaaatgaaaaacgaactgaagcagtaacacaaactttacaacgtcacatcaagactttctctcgtattgagaaagctttttatggtgctattgtaattactgctattatcatggcagtcggtattatttacttgcaaagtaatagtttacaagttaaacaagaagtaaatcaattaaatagtaaaatcaacgataaacagacagaatttgacaatgctaaacaagaagtaaatgagctttctaatcgtgatcgaattactaaaattgctaaagatgctggtttaacaattcaaaacgacaatatttatcggaaggtggactagtctgtgactttttttaaaaagctaaaaaaaatcttccttgattatgtgatccatataagagataggcgttcgccgcagaaaaatagggaaagagtaggtcaaaatctgatgattttaaccattttcctatttttcatttttatcatcaactttgtcatcatcgttggtacagatagtaaatttggggttaatttatccaaggaagccaagaaagtctatcaacaaagtatgacagtacaggcgaagcgtgggacaatttacgaccgtaatggaaatcctatcgctgaggatgctacgacctatagtctctacgctattatctcaaagaactatacgacagctacaggtcaaaaactatatgtacaaccttctcagtatgaaaaagtagctagtatcttagagaataaattgggcatgaagaaaaatcttgtcctaaaacaactcaatcaaaagaaattgtttcaagtttcctttggaagttcaggttcaggattgtcttataccaagatggctgacatcaagaaaacgatggaaaagtcagatatcaaaggaattggtttttctaccagtccggggcgtatttatccaaatgggatatttgcttcacaatttataggatttactcttcctcaggatgatggagatggaaaaaaattagttggtaatacaggccttgaagcggcacttaacaaggtattatcaggtactgatggtaaagtaacatacgaaaaagaccgtagtgggaatgttcttttaggtactgcaacaacagaacgtagggcggttaatggtaaggatatctacacaactttatcagagcctattcagactgttttagagactcagatggatgttttcgcagaaaaaaccaaaggaaaatttgcgagtgctacagttgtcaacgctaaaacgggtgaaattctagcaacgagtcagcgtcctacttataatccttctacccttaaaggttacgataagaaaaatttgggtacctataacacactactatatgataacttttttgaacctggttcaacaatgaaggtaatgactctagcctctgcaattgattctaagcattttaactctactgaagtgtataacagtgcacaatataaaattgcagatgcgattattcgagattgggatgtcaatgaagggttatcatctggtagttatatgacttttccacaagggtttgcacattccagtaacgttggtatggtaaccttggaacaaaaaatgggacgagataaatggttaaactatctttctaagtttaaatttggttacccaacacgttttgggatgcttcatgaaagtggaggtttgttcccatctgacaatgaagtaactatcgctatgagctcatttggtcaaggtattggtgtaacgcaagttcaaatgttgcgcgcatttacgtctatctcgaatgatggtgttatgttacaaccacagtttattagcagtatttatgatccaaatacagggacttctcgtacagcacgaaaagaagtcgttggaaaaccagtttccaaagaagcagctagtaaaacacgtgattatatggttactgttgggacagatccttattatggtacattatacgcagcaggtgccccagttattcaggtggggaatcaatcagttgcagtaaaatctggtactgcccaaatcgcccaggaaggtggtggtggttatctgcaaggaaaaaatgatactattaactcagttgtggctatggtgccatcggaaaatcctgacttcatcatgtatgttaccatccaacaacccgaaaaatttagtatcacattctggaaagatgttgttaatcctgttttagaacaagcaacagcaatgaaagaaacgatattaaaaccgggattgaatgactcagaacatcagacaaaatataaactatcaaaaatagttggtgaaaatccaggtcatgtagcggaagaattacgtcgtaatctggttcagccaattattttaggaaatggtagtaaagtttctaaagtatctaaaagaccaggagctaatcttgctgagaatgaacagctactagtattaacaaataaactgactgaattacctgatatgtatggttggtctaaagcaaacgttgaacagtttgctaaatggacaggtataaaagtgacctataaaggttcaacctcaggtaaagtaagaaaacaaagtattgatgttggaaaatccatcaataaaattaaaaaaatcaaaattacaataggagattaacatgtttttaagtataatggcaggtgtcatagcatttgtcctgacagttattgccattccgcgcttcattaagttttaccaattgaagaaaattggcgggcaacaaatgcatgaagatgtcaaacaacatctagccaaagcaggtacgccgacaatgggaggaacggtatttttgattgttgctcttcttgtctcacttatttttagtattattttatctaaagaaaatagtggtaatttaggtgcaacttttggtattttatctgttgttctcatctatggaattattggttttttagatgattttttgaaaatttttaaacaaatcaatgagggcttgactccaaagcaaaaaatgtcgctccaactaattgcgggtctaattttttattttgtccatgtgttaccaagtggcacatctgcgataaatatttttggtttttaccttgaagtaggatacttatacgctttttttgttcttttctgggttgttggtttttcaaatgctgtgaacctaacagatggaattgatggtctagcttctatttcggttgttatcagtttgattacttatggaatcattgcttataatcaaacgcaatttgatattttattgattatcgttatcatgattggtgctttacttggcttttttgtctttaatcataaaccagctaaagtctttatgggagatgttggttcacttgcattgggtgctatgttagcagccatttcaattgccttacgtcaggaatggaccttgctttttatcggctttgtctatgtttttgagacgtcttcagtgatgttgcaagtagcatactttaagtatactaagaagaaaactggtgttgggaaacgtatcttccgcatgacaccatttcatcaccatttagaattaggtggtgtgtctggcaaaggtaataaatggagcgaatggaaagtagatgcttttttatgggctattggtattttcatgagcgctattacacttgctattttatatctttaaactttattaggggatgtggtatggactgccagattcccttttgctttcttgtagcctttaatggtataatgaacataataatagtaaggaaatagacatgtcatttaaagattttaattttaaaccatacattcagagggctctcgatgagttaaaattcgtcgatccaactgatgttcaagctaaattgattccagttgttcgttcaggccgcgatcttgtgggggaatcgaaaactggttctggtaaaacccacacctttttacttcctatttttgagaagctagatgaaagtagtgatgatgttcaagttgttattactgcaccaagtagagagttgggaacacaaatttatcaggcaactaaacaaattgctgagcattcagagcaagaaatacgggtggttaactatgttggtggtactgacaaattacgtcaaattgaaaagttgaaagtaagccaacctcatattgtcattggaaccccaggacgaatttatgatttggtgaagtcaggtgatttagctattcataaggcgcatacttttgttgttgatgaagcagatatgactctagatatgggatttcttgataccgttgataagattgcagggtctttacccaaggatgtccaaattttagtcttttcagcaacgattccacaaaaattacagccatttttaaagaaatatttgaccaatcctgtaatggaaaaaatcaaaacagcaacagttatcgctgataccatcgataactggcttttgtccactaaaggacgtgataaaaatgcacaaattttggaactctctaaactaatgcagccctatcttgcaatgatatttgttaatacgaaagagcgtgcagacgaattacattcgtacctttctagtaatggcttaaaagtagctaaaattcatggtgggattgcacctcgtgaacgtaaacgtattatgaatcaggttaaaaacctcgaatttgaatatatcgttgcaacagatttagcagcgcgtggtattgatattgaaggtgttagccatgttatcaatgatgccatacctcaagacctatctttctttgtccaccgtgtcggtcgcacaggccgtaatggcttatctggtactgctataactttatatcagccaagtgacgattctgatattcgtgaacttgaaaaactaggtattaattttattcctaaagtcattaaaaacggtgaatttcaagatacatacgaccgtgatcgtcgtaataaccgtgaaaagtcctatcaaaaattagatacagaaatgattggacttgtgaaaaagaaaaagaaaaaaataaaaccaggttacaagaaaaaaattcaatggaaagttgatgaaaagcgtcgcaaagagcgtagagcaagtaatcgtgctaaggggcgtgcggagcgcaaagctaaaaaacaaagtttttaaaattattaaagtctgaaatcagctcgtttcaggcttttttattgatataaaatctttatcacctgataaggaaatactattatacagatagattttagagtgttagactagtaatatgatattttaggagaattcttatgtttaaaaaaataatattatctattgcaactatagccgcaaccgccagcctagcagtatcagttcaggcgtcagagaaagtagaacttaaagtagctacagattctgacacggcaccatttacttatcaaaaagacgggaaattcaaaggttatgatgttgatgttgtcaaagctgtttttaaaggtagtaagtacaaagtaaccttcaagacagttccttttgatactatttcaacaggtattgatgcagggaaatttgatttatcagctaatgatttttcatacaataaagaaagagcagaaaaatatctcttctcagatcctatatcccgttcaaattatgccgtagtagggaagaaggggagccattacaaatcattaagtgacctctctggaaaatcaaccgaagttttatctggcgttaactatgcacaggttctagaaaattggaataaaaatcatcctaataaaaaaccaataaaaatcaaatatgtttctgggacaactggtgttactagcagattaaaaaatattgagagtgggaaaattgactttatcctatatgatgccatttcatccgactatattgtaaaagaccaatcattaaacttaagcgtttctcctttgaaaggtaaaattggtaataataaggatggactagaatacctccttttaccaaaagataaaaaaggtaaaactctacagaaatttataaataagcgtattaaagttttgaaagaaaatggtactttggcacgtttaagtaaacaatatttcggtggagattacgtttcaaacattgataaataaatcagtgagactataagttttatctttttacatgtgagagtttgcgtgatagaataacggagataagaaagtttagaaaaggaaagtagaaggaatgaatcaatttatcttgacgggtggatggtcttggtataataatttggttagtcaggttccagcggggaaattatttagttggaaggctgttttagatgcaataccctcaattttagagcgattacccataacactattattgacagtagcaggagccttatttggactcattttagctttgatttttgcagtagtgaaaattaaccgtgtcaaaattttatatccgattcaagctttatttgttagttttttacgtgggactccaatacttgttcaattaatgctgagttattatggaattccacttttcttgaaatttttaaaccaaaaatatggttttgattggaacattaatgctataccggcttctgtatttgctattactgcatttgcttttaatgaagcggcttatacaagtgaaactatacgagcggcgattttgtcggttgatcaaggtgaaattgaggcagcacgtagtttagggatgacctcagcgcaagtttatcgtcgtgttattattccaaacgcagcagtagtcgcaacacctactttgataaacacgttaattggtctaactaagggaacctctttagcttttaatgctggtattgttgaaatgtttgcccaagcacaaattatgggtggtagcgattatcgctattttgaacgttatatctctgtggcacttgtttactgggcggttagtttcttaattgaacaattgggaaatgctattgaacgaaaaatggcaattaaggctccacgccatttaactgatgagattccaggaggagtacgctaatgataaaattgagacaattgactaaatcattttctggtcaaaaagtgttagacaaacttgatttagatattgaaaaaggtcaagttgttgctctagtaggtgcttcaggtgcaggaaaatcaacctttcttcgtagtatgaattatttagaagagcctgattatggaacaattgaaattgatgattttaaagttgattttaaatcaatcagtaaagatgacatactaacattacgccgtaagttagccatggtttttcaacaattcaatctatttgagcgtcgtacagctttggataatgtaaaagaaggtttgaaaattgtcaaaaagatgtcagatcaagaggcaacacggattgcaagagacgaactggcaaaggtcggacttgcagatcgtgaaaaatattatccaagacatttatcaggtggacagaaacaacgtgttgctttggcacgcgcattagccatgaaacctgatgttcttcttttagacgaaccgacatcagcacttgatccagaattagttggagaagttgaaaaatctattgcagatgctgctaagcaggggcaaaccatggtacttgttagtcatgatatgaattttgtttaccaagtagcagataaagttttatttttggaaaaaggtcgtattttagagtctgggacgcctgaacaattatttaaccatcctttagaagaacgtacaaaagaattcttcgctagttataacaaatcgtacctataagctaaaatattttgatataatgaaggttagaatgtctaatcttcatttttaattattcttgagttaggctaagtatataagaaagctgcgatatgttttgacaatcgcttgttggatagagatgtttttagaaatagcaaaagtttatttacaaggtttagggcttgccagcataactgttattttagttggtataatttgggtcttttggcgtgccaagaaaaacatagataaaacagctagagaacgccaatctgttctttatgatgtccttctgatagctcttatgacagctccaatacttgcctttgcatttgtagctatcattttaatgataaaagcttagtcagattagttggaaatatagacgctttgctatagaataaaaccataagattcaaaggagaaatagtaatgtatgatactttaataataggttcaggtcctggtggtatgacagcagcgctttacgctgcacgttcaaaccttaaagttgggttaattgaacaaggtgctccaggtggacagatgaataatactgctgaaattgagaactatccaggctacgatcatatctcaggtccagaattatcaatgaagatgtatgagccgttggaaaaatttgaagtagagcatatttatggtatagttcaaagagttgagaacgatggtgatgtaaagcgtgttatcaccgaagatgaatcgtatgaagccaaaacagtaatccttgctaccggagctaaaaacagccttttaggagttccgggtgaagaggaatatactagtcgtggcgtttcttactgtgcggtttgtgatggtgcatttttccgtgatcaggatcttttagttgtgggtggcggtgattctgctgttgaagaagctgtcttcttaactcaatttgctaaaagtgttactattattcaccgacgtgatcaattgagagctcaaaaagtacttcaagaccgagcttttgctaacgaaaaaataaaatttgtatgggattcagtggtcaaagagattaaaggaaatgagattaaagtatctggtgtaactgttgaaaatctaaagactggagaaatctcagagatgactttcggaggtgttttcatttacgttggtttgaaaccacattctagcatggtctcagaattaggtattacggacgagactggctgggtcttaactgatacaaatatgaaaacatcaattccaggactatatgctattggggatgttcgtcaaaaagatctacgtcagattgcgactgctgttggtgaaggtgctatcgctggacagggtgtctataactatataactgagcatttctaagaaatactaaaagtagaaaagactatcgaaaaacgattagtctttctttttattttcatgaaagtaaggtgataaactgaactaccgagatagaaatatgctataatgttagacatatagccttatcctaggctcatgattaaaaggagattgtctgatgtataaagacgatagtttaacactacatactgatttatatcaaatcaatatgatgcaagtttattttaataaaggtattcacaataaaagagcggtgtttgaagcttactttcgcaaggttccatttgaaaatggttatgctgtttttgcaggtttagagcgtattgttcgttatttagaaaatctgagcttttctgatagtgatttatcctatttagaagagttaggttatcctgaagaatttttagattacttaaaaaatttaaaaatggaactgactgtcaaatcagccaaggaaggtgaccttgtatttgctaatgaaccattagttcaaattgaaggtcctttagcacaatgtcagttagtagagacagcgattttaaatatcatcaactaccagacacttgttgctacaaaagcagctcgtattcgttctgttattgaagatgaaccgctattagagtttgggacacgacgtgctcaagaaatggatgcagccatttggggtactagggcagcgattattggtggtgctaacgcaacgagcaatgttcgtgctggtaaaatctttaatattccagtatcaggaacgcatgcacatgctttagttcaaacttatggcgatgattaccaggcatttaaagcttacgcagaaactcataaagattgcgtctttttagtggatacttatgatacccttcgtgtaggtgtgcctaatgctattcgagttgcaaaagagatgggcgaaaagattaatttcttgggagttcgccttgattcaggtgatttagcttatttgtctaagaaagttcgtcagcagttagatgacgccggttttcctaatgcaaagatttatgcttcgaatgatctagatgaaaatacaatcctcaacctaaaaatgcaaaaagctaaaattgatgtttggggtgtcggaacaaaattaattacagcctatgatcagcctgcgctaggtgctgtttataaaattgtttctattgagactgacgccggtagtatgcgagatacaattaaactatcaaacaatgctgaaaaagtatcaacacctgggaaaaagcaagtttggcgtatcaccagtcgagctaaagggaaatctgagggtgattacatcacatttgcagacactgatgtgacacaattagatgaaattgaaatgtttcatccaacttatacttatatcaataaaacagtccgtgattttgacgcagtacccttactggtagatatctttgacaaagggaaattagtttatcaattaccaagtcttcaagaaattcaagagtacggacgcaaagaatttgatcagctttgggatgagtataaacgtgttctgaatccacaggattacccagttgatttggcacgcgatgtttggcaaaataaaatggacctgattgatcgtatccgtaaagaagctttggcaaaaggagaagtaagatgactttgcaagatcaaattatcaaagaactcggtgtaaaacctgttattaatccaagtcaagaaatccgtcgttccgtagaatttttaaaagactatctattaaaacatagttttctaaagacctatgtactgggtatttcaggggggcaagattcaactttagcaggacgtctagctcaactagcagttgaagagttgcgtgctgatacaggggaaaactatcaatttatagctattcgtttaccatatggtattcaggccgatgaagaagatgcacaaaaagcattagattttatcaagccagatattgctttgaccattaatattaaagaagctgttgatggccaagttagagctcttaatgcagcaggagtagagattacagactttaataaaggaaatattaaagctcgtcaaagaatgattagtcaatatgcagttgcaggtcaatatgctggagcggttattggtactgatcatgctgcagaaaatattacaggttttttcaccaaatttggtgatggaggtgctgacttattacctctctttagacttaataaaagtcaggggaaacagttattagctgaacttggtgctgataaagccttgtacgaaaagattccaaccgcagatttagaagaaaataaaccaggaatcgctgatgaaatagcccttggagtaacctaccaagaaattgatgcttatcttgaagggaaggtggtttcggacaagtctcgaggtatcattgaaaattggtggtataagggtcaacataaacgtcatcttccaatcacaatttttgatgatttctggaaataagaaaaatagctagaatattctagctatttttgtttctctaataaattactttcagacttgcagaaatattcagaatgtttataatagtagctaagtataaaaggaggaatttatgtcaaaattaactcaaacatttacagataagttatttgctgattaccaagcaaatacaaaatttagcgctattgaaaatgcagtaactcacaatggtttattgaagtctctagagactcgtcaaagtgagattgagaacgactatgtcttttcaattgatttgaccaaagatgaagtttctaatcagaaacaatcaggacgttgctggatgtttgctgcactgaatacatttcgtcataaactgatttcagattttaaacttgagaattttgaattatctcaggcacatacatttttctgggataagtatgaaaaatcaaattggtttatggaacaaattattgcgactgcaaatcaggaattgagtagtcgtaaggtgaaattcctattagatgtacctcaacaagatggaggacaatgggacatggtggttgctctgtttgagaaatatggtgtcgttcctaaaacagtttatcctgaatctgtttcatcaagtgctagtcgtgaactaaatcaatatttgaataaactcttacgccaagatgcacagattctacgagaattaatagcacagggagcagatggggcaactgttcaaaataaaaaggaagaattgcttcaagaaatttttaactttttagcaatgaaccttggcttgccaccgcaatcttttgattttgcttatcgtgataaagacaatcattatcagtctgataaaaatattacaccgaaagcattttatcaaaaatatgttaatcttgacctatcagattatgtttctattatcaatgctccaactgtagataagccttatggacaatcctatacagttgagatgcttggaaatgttgtcggagggccagctgttaaatatttaaaccttgatatgaaacggtttaaagagttagcgattgcgcaaatgaaatcaggagaaactgtgtggtttggttcagacgtaggtcaagtatcaaatcgtcaaaagggtatcctagcaactacgacttatgattttaattcatctatggatattaaacttagccaagacaaagcgggccgcctagattatagtgaaagtttaatgacacatgctatggtcttaacgggagtagaccttgatgaatctggacaacctttaaaatggaaagttgagaactcttggggagagaaagttggtaaggatggttattttgtagcttcagatgcttggatggatgaatatacttaccaaatagtcgttcgtaaagaattgcttactaaagaagaattagaggcttacaacgcagagccaattactttagcgccgtgggatccgatgggagcattagctaattagtaatagtaattataaattaaaaaactggataatatatccagttttttaattaccgttaggtactgtattgttgttaccattaccattaccattaccatgtccagttcctggcacagtttgattggaattattaggggtagtagcattaccattattaggtgtttcgacttgtggggatgatgaattggcatcatttgctgtattcttatcctctttttgtttctcagaggatgttgaactactgctttgacttgactgtccagaattttgatagatattcttatagacagaagaagagtaagtgccggttgtagttgtcccattgatatacaagtagcttccgcttcgatagagcccttctggcattgtccaatctgcactgtatccgccagttaggtaggacatcattgcacgataaacctcagtagcaatatccagttggctaccataaagtggtgtaaggcgatttttataaccagtccaaattgccattgtgtacttagaagtatagccgacaaagttttcatcaggagccattgtaccaacggcgctattgtagataccagtagttgcttcaattttagctaactcatcttccgtatagttggaagtaccagtcttaccagcttgtgcaacaccagggatagctgctttagtaccagtaccaaatgttagtactgttttcagcatatccgtcatcatgtaggcagtagtctctttcatcgcacggctaccagacgctgcataagtatcattggttccatcgctaaattcaattttattaacatattgcggtttatagtaagttccgccgtttgcaaaagccgagtaagccgctgccattttctcactacttgcaccatattttgcatcactgctactgttgttacttgaaatagcatttgaatagttcatttctggatagtatatgcctaatttttcaaggaaagattttgcttcgtctaatccagcggcttcaagtgctctgacagcagggacgttacgtgattgttgaatagcggtctgcatactcatccaacccatatattgacgatcccagtcatatagttgagtagaagtaccaggccagtagtaaactgagtcgtttaatgattgacctgttgaattatagacaccactatcaatagcaggtgcataagctgagataggtttcattgtagaaccccaatcgcggtctgttaagacagattgatttgtcccaaatgaaatattttcattctgatgacgcccgcctaattgtgcaatgactttaccattagtcgcatccatgatggtagatgctatttgtaattcattgtttggataagcgatgtaagtgtcactgttgtagatgtcatatagttgtttttgtgcatcagtgttgatattagtatacacttttagcccagcagtaaagatatctttaccagttttttgtttaacttcactaataacttgttttaagtagttatccatatattttggataagtagatttttgctttaattcttttaagccatcagttactggagttgcaacagcttggtcgtattcctttttagaaatgtttttatcttgatacatctgctgaagaacggtattacgtcttgtttgagcagattctgggtttttataagggtcatattgtgtaggtgcttgaggaataccagcgagcaaagcaagttgtgcaatagataattcctttaggtctttaccaaagtatgatttagctgttgttctcataccataattcccatttcccatataaactttattaatatagaaagtaagaatttcttctttggtgtatttacgctccatttgaagcgcaagccaaacttcctgtgatttacgttttaacgtttggtcagatttattggtagaaaagtaagccagtttaatcaactgttgatcaagggttgaaccaccttgcgtattactactaacaagattatgccaagctgcacctaaaatacgataaatatcgacacctctatgtttaaagaaacgtttatcttcgatagaagtgatagcgttaaccaaatttagtggaatgctatccgcactaacactttcacgcttttctgagcctaaatcggcaataagtttattattaccatcataaaccaaactagagttaacggattttaaagcttgatcggttaatttcggagaacgactaacgtagtatgcaaataggagcccacctattacaatagctaagataataaatcccattataatgccaaaagcatacttcaatagtttgataacagattcctttttaattgtaatcaccgcctaataatttttcttcaataatatctaagtaagggacttgaggaaaggcactctcctttacgaaaaatccattttttctgatataatcaataggcattgatttattgcctttatcaatctgataaaatgaaattaactcattagcagggagtagataggtttccttaagtgtggaaaaatgaagcaagacaaagcaaatccctttttgctgtaatacatttgccatgtgctctatttggtgagcatgaaaatttttcataggcatagcagttttctgccgggtttctttggcttcaaagtcaatatagtaacctttgtaaacaccagaataatcagtagtagaagcttgtctaaaataagcttctacaatcttagcacgactacgtttaggataatctaccttgacgatttgtactggcgttggtttcttatgaatgacagctaattcgtgagacaaatagtagtcattggttgcattgatagcagcttcaaatgacataccacggttggcaaaatcgattttctttttctttgattttgtaactgttgttttccgaataagctgatgtggatagttaaccatttttctccttgcattacaaataaaatgctaagataagcaaaactattataccataaaattaggatggacaacaaatgaagtcaactattcttgtaacaggttacaaaaattttgaattagggattttccaggataaggatcctcggattactattataaaaaaggctattgataaggattttagacgcttcttggaaaatggagcagactggtttatttttatgggaaatttagggtttgagtactgggctttggaagttgctcttgatttacaaaaagaatatgattttcaaattgcgacaatttttacctttgagaaccatggccaaaattggaatgaggctaataaagctaagttggcactctttaagcaagttgactttgttaaatatactttcccaagctatgaaaacccgggtcaatttaaacaatacaatcattttctcattaacaacacacaaggtgcatatcttttttatgattctgaaaatgaaactaatttaaaatttttgctagaaatgatggagaaaaaggaagcttatgatatttctttcctaacttttgatcgcttaaatgaaatatatgaggaatgatcgttttttcggatatgagaacgttttacgcttgatttttccatttaatttaggtattatttactttgatataaaggataggacttatattaaaacgatttgactggtttggagaatagaatggcaagtattatttatagcccaaaagatatttttgagcaagattttaaagttagtatgcggggatatgacaagaaagaagtcgatgtatttctggatgatgtcatcaaagattacgaaaattatcttgagcaaattgagaagctccaaatggaaaatagacgtctacaacaagctttagacaaaaaagaaagcgaagcttcaaatgtaagaaattcagggacagctatgtataatcaaaaaccgattgcccaatctgcaaccaattttgatattttaaaacgcattagccgccttgagaaagaagtttttggaagacaaattagagaataaggatttctcaaatatgcaatttttggataatcgcgtagtattgagatactatgaggaaagtccatgctagcactggctgtgatgccagtagtgtttgtgctaggcgaaaaaataagcctagggagatagctagctatcttacggcaagcaaaagggctaagtctttggatatgcctgaatagctttgaaagtgccacagtgacgtagtttctagggaaatctagaaagtggaacgcggtaaacccctcaagctagcaacccaaactttggtaggggcatgggatagttggaatgagaacaatctatcctgactgctttgcagtagacagatgattatcgaaagaaacaattcctagttgtttctggaacaaaacatggcttatagaaaattgcataataggttagtggctgagataacatctcagccaatttttaactgtgatgaatacgatagtgtaaaagaggaaaaatgaaagaatcattcaaattaatagcaactgctgctgctggtttagaagccattgttggtagagaaatcagaaacctaggaattgactgccaagttgagaacggtagagtccgtttccacggagatatcaaaacaatcattgaaacgaacctatggctacgagctgccgatcgtataaagattattgtaggagagtttccagcacctacttttgaggaactttttcagggtgtatatggccttgactgggaaaattatttaccgttaggggcaaaatttcctattgctaaagcaaagtgtgtcaagtcaaaattgcacaatgaacctagtgtacaagccatttctaaaaaagctgttgctaagaaacttcaaaaagtctttcaccgtcctgaaggagttcccttacaagaaaatggagctgaatttaaaatagaagtttctattttaaaagataaagcgactgtcatgattgatacgactggatcaagtctcttcaaacgtggctaccgtgcagaaaaaggtggtgcaccaattaaagaaaacatggcagcagctattattcaattatctaattggttccctgataagccattgattgatccaacttgtggttcaggtactttttgtattgaagctgctatgattggaatgaatatagctcctggttttaatcgtgattttgcctttgaggcgtggccatgggtagatcaaagtcaagtacaaaaggttcgtgatgaagctgagagtaaagcaaactatgatattgatttagatatttcaggttttgatttagacggtcgtatggtagaaattgctagaaaaaatgcagaagaagcaggacttggagatgttatcaaattgaaacaaatgcgtcttcaagatttaaaaacagataaaattaacggtgttattatctccaacccaccatatggtgaacgactcctggatgacaaagcagtggacattttgtataatgagatgggacaaacatttgcgcctttaaaaacttggagcaagtttatcctaactagtgacgaaggatttgaaaaaaaatacggctcacaagctgataaaaaacgtaagctttacaatggtactttaaaagttgatttgtaccaatattacggtgaacgtgtgagacgtcaagtaaaataacggggagaactcatgtcagaagatcaaaaacacccattttttgaaccaaaaaaagaaactgatggtcttgaatttaaagatgctaaagaaatgacagtagaagaggctgttagaaaagattctgaaattaaggctggtattaccgaagaagatagtattcttgataaatacatcaaacaacatcgtgatgaagtagcttcacaaaagtttgagacaaaatcaagcgattttgcaaaccttgatacggcatctttagatgattttatcaagaaacagcgcgaagaattatcagcgatgttagctgcagaagagctttctaaaaagttggataattcagtctctcaagaacaagatacagaagctaatgctgtctcacctaaagaagaatcttcacaagaacaagaaaatagtgtaaccccagttcctcctctgaatacggaagcagaaccaactgcaacagaaccagattcgactattgctgattcagaggagtataaatcctcttctaagaagcgtggaggtatcgtaggaacattgattgctcttattttacttctaatagtagcaatctttggttacaactatttcaagaataataattcgacaaattctcaaactgcaacaagtcaaagttctagttctaaggctacgacgacttcatcagaagaagataaaaaagctagtcagaacttagataatttcaacaaatcttatgctaacttttttgttgatgataagaaaacccaactcaaaaatagcgaatttgataaattgtcagaattagaaaagaaagttgatgctttaaaaggaactaaatactacggtaaagtaaaagttaaatttgatagtctaaaacgtcaaattgatgctgttaaagctgttaacgacaagtttaagtcgcctgctgtagttgatggtaagaagagtgaaaaattagaggtaaaagatggagcgaattttgactctttagatagtaaaactcttaatactggtaatgctagtctagatagtttacttcactccatcgtttcaactggtcgtaatcaggtaaaacaatccgaagaacaggcttcgtctaataaggtttcagacactcaaataactgaacaaccaaacgtaactaacggtcaatcttcctcatcagctgctacaataaataatcaggcagctggcactgcatcaggtaatttggaacgtaaccgtagtcgagtaccgtataataatgctgctattgcggatacaggaaatcctgcctggatatttaacccaggagtattagagaaaatcgtggccacttcacaggcgcgaggctatttctctggaaataactatattcttgaacctgtaaatattatcaatggtaatggttattacaatatgtttaaattagatggcacttatttgttctctatcaatgccaagacaggttactttgtaggtaacgctcctggaagagctgatagtttagattattaatataaagaacaaaaccagttttttgtctacaccctaaaagttagaaaatcagtctaacgattagggtgttttttgtattcgcatttagatgtctacgactgctatgaggatattagggaaaaattaaaaggattttgctctctatgatacagaacaaaatcctttgtttaaattaataagtcaacttttggaattccaaaagttgacttttattttttattagatcagacaatgtggcgctcaaaagcattgtcagaaatcccttgggaaagaattaatttcgcccattcttgagcagagtggagactgtggtctttataatttccacaagattcaatggttgttccaggaacgtcttcccaagtgaccccaccagcaatagcctctagactagatttgatgactttagcaatttcagtagcatcctgttttccccacataatcatgtgaaaaccagttctacaaccaaaaggagaacaatcaatcaaaccattaattcgttggcggattaacttcgccagaaggtgctcgatagtatgtaaaccagcagtatcaatagcattttcattaggctgaataaggcggatatcaaagttagtaatgatgtctccgaccggtccaacttcttctgaaattaaacgaacgtagggtgctttaacgatggtgtgatctaattcaaaactctctacgacaacttcttttgtcataagttttctccttttgtattacattctagagactaaaggagatgttgaaaatttctcctaatccctttaaataacattctaatcatatcataaatgtctataattttaaattgtgaaaacgccttttttatgataaacttaaaagtggactttctatatgaaatctagaaaaaaattgaggtataaacatgtttaatattatattagcaatggtttgtgcactcattggtttgattattggttatgtggctatttcaatgaaaatgaaatcatcaaaagaagctgcagaactaactcttttaaatgcagaacaagatgccgttgatttacgtggtaaagcagaaattgaagcagaacacatccgtaaagcagcggaacgtgaaagtaaagctcaccaaaaagaattacttttagaagcaaaagaagaggctagaaaatatcgtgaagagatcgaaaaggaatttaaatctgatagacaagagttgaaacagatggaggcacgtttaacagatcgtgcatcatctcttgatcgtaaagatgaaaatctatctaacaaagaaaaaatgttagatagcaaagaacaaagtctaaccgataaatctagacatattaatgagcgcgaacaggaaattgctactttagaaacaaaaaaagtagaagaattgtcacgcatcgcagagcttagtcaagaagaagctaaagatatcattttagctgataccgaaaaagatttagctcatgatattgcgacacgtattaaagaagcagaacgtgaagtaaaagatcgatcaaacaagatagcaaaagacttgctagcccaagctatgcaacgtttagctggtgaatatgttactgaacaaacaattacaactgttcatctccctgatgataatatgaagggacgtatcattggtcgtgaaggacgtaatattcgtactctggaaagtttgacaggtattgatgttatcatagatgatacgccagaagtcgttgtcttatcaggtttcgaccccattcgtcgtgaaattgctcgtatgactttagaatctttgattcaagatggacgtatccatccagctcgtattgaagagttggttgaaaaaaatcgtttggaaatggatcaacgtatccgtgagtatggtgaggcagcagcttatgagattggtgcaccaaatctgcatcctgatttgataaaaattatgggacgtttgcagttccgtacatcatatggtcaaaatgtacttcgtcattcagttgaagttggtaaacttgcaggtattttggctggagaactaggagaaaatgttgatttagctcgtcgggctggattcctccatgatatggggaaagctattgatcgcgaagttgaaggcagtcacgttgaaattggtatggaatttgctcgtaagtacaaagagcatccgattgttgttaatactattgcaagccaccatggtgatgtagaacctgacagcgttattgcagtaattgttgctgctgcagacgcccttagttcagcacgaccaggtgcgcgtaatgagtcaatggaaaattatatcaaacgtctgcgtgatttagaagaaattgctaatggctttgagggagtgcaaaatgcctttgcacttcaagccggacgtgaaattcgtatcatggtacaacctggtaaagtttctgatgatcaagtagttattatgtcgcataaggtacgtgaaaaaatcgaacaaaacttggattatccaggtaatattaaggtaacagttattcgtgaaatgcgagctgttgattttgcaaaatagtcaaaaggagagcttgttagctctccttttgttatagagttgacatttgtcatattttgaaatgacaaaaatatctaaaaagtttacttctgattttttatactatgattatagtaaaggagaaccaaatggcaaaagatataattaaggttgatcatatatttaaaagcatcgggcaaaaaacgattttagaagatatatcatttagtatagcttctaaccaatgtgtagcattgattggacctaatggtgcagggaaaacaactctgatgtcaactttgttaggtgatattagtatttcttcaggatcattgacgatttttaatctgcctgcacaccacaataggttaaaatataaggtggccatcttaccacaagaaaatgtattgccctcaaagtttacagtgagagaactcattgatttccaaaggtgtttatttccagaagtgctgccaatgtctctgattttagactatctacagtggagtgatacgcacttgcaacaatttacagagactttatctggagggcaaaaacgacttttagcttttgttttaactttggttggtaagccccaattactatttttagatgaacctacttccggaatggatacttccacacgtcaacgattttgggagctgattgcgacactaaaaaaagaaggtgtcacaattgtctattctagtcattatatcgaagaggtagaacatacagctgataggattttagtacttcataaaggaaagttattacgcgatacaacccccctttgccatgaagcaagaaaaaaccgaaaagttattcaccgttccgcttagttatcaaaaattattacctacctatttgattacagagtgtgaagccaagagtgatagtataacgtttgttactggggaggctgaagctgtatggaaaatactggcagataatggttgtcctattgaagctattgagatgaccaatagaactttgttaaatcgtatttttgagactactaaggaggtaaaacatgagaatctttaaagcattattgaaaatggaatttcttttgacaaaacgtcaacttgccaatctcattatggctataggtatgccagtggctttttttctatttttttcaggatttatgggcgaaggactcactaaagccatcgaagctatctacgttcgtaattatatgataacgatggcaggattctcaagtcttagctttgctttttttacttttccattttctatgaaagatgatcaactctcaaaccgaatgcaattattaagacactcaccagtaccaatgtggcaatattatctagcaaaaattattcgtattttattttactattgcctagcaataactgttgttttcctaactgggcatattttaaggcaagttagtatgccaatagaacaatggatgcagagctttttattgctattaggaggagcaacatgttttattccttttggattgctcgtctcctactttaaaaatactgaactaatgtcaatggtagccaatatttgttatatgtcattagctgttcttggtggcatgtggatgccaattacaatgttcccaaaatggttgcaagctttatcaaagttaacccctacttaccatttgactcaagttatccttagtccgtttgctaatagttttgctggtttttctcttattattctgataggctatggtattataatgttagttatcgcttatctactatctcagaagaggcattcaatttgaaaaataaaaaaaataactatgatttaatgtattttattccgttagtatttttgatttaccccataggagggattctctattatcactaccctttttggactttattttttacgctagcttttgtaggagcatatttatactctgttattatcaggggcgaatcaaagtatcacatgattgcctggtctacaatgttgacatatattttctacatgacaatttttataaatagtggtttcatctggtatatttactttctgagtaatttactcgtctatcgctttagagataaattgaagtcttttagattcattagttttgcttgtactctagccacagtggtatttttatgcttctttaaggcatcagactttggtgatagaatcatgtttctaattgttcctattttttgtatcggttacatgtggattgctattgaaaatagaaatagcgaagaacaaagagaaaaaattgcagagcaaaatcagtatatcaatattttgtcagctgaaaatgaacgtaaccgtatagggcgtgatttgcatgatagtttaggacatacatttgctatgatgacactaaagacagaactagcgttaaagttgttagaaaaaaggaactatgataaggtacaaaaagaactatcagaattaaatcatattagtcatcaatcgatgagtgaggtccgtcaaattgtttctaacctcaagtatcgtacagtagtggaagaaattgatgagttgtaccgcttgtttcaattatctaacattaagttaacagttgttaataagttagagacgtcacaactaagtccagtaacacaatctacaatcacaatgatattaaaggaattatccaataatattgttaagcatgctgaagctgatagcgtggagttgagtttagtaaggcaaggtgctactataaatattgagatgattgataatggttgtggttttacaaaccttgacggagatgagttgcatagtattcaagagagattaactatcgttgaagggacactaacgattttgtcccgaagtaaaccaactcatattcaggtggtattgaaagaggtataagatgaaattacttgttgctgaggatcagtccatgctacgagatgctatgtgccaattacttttgatggaagaaagtgtttctactattgatcaagctggaaatggtggagaagctattgccattttatccaataaagccatagatgttgcaatattggatgttgagatgccgatattatcaggtttagatgtcttagagtgggttagaaaataccagaatgttaaggtcataattgtaacaacctttaagcggtcaggttatttccaaagggctattcgttcaaatgtagatgcttatgttttgaaagaccgctcagtagctgatttgatgaaaacgattcaaaaagttttatctgggggtaaagaatattcgcctgaattaatggaaaacgttatatctaatcctttgagtgagcaagaaataaaaattctttccctaattgctcaagggaagaccagcaaataaattgcatgcactttatttttatcgaatggtacagttcgtaattacacgtcaaatatttttgataaattaggagttaataatcgtttggaggcacttaaaatagcacgagaaaaggattggctgtgatagtttttttccagtcgagatgccataatgtattaagagggatgtatgtatgcaaaaatttaaagaacgttttgatacgcttagtgatgcaattttggccattgctatgacgattttagttttggagataaaaactccggctacgatgggtgatattggtgactttacacggaacataggtttatttattgttagctttgttgttgtttttaatttttggtacgaaagggcacaaaatagcctagatgctcaaaagactaatgatgaaattatagctcttgatatcattgaacacctaggtatttgtttgattcctctctttactaaatttatgatttcttttgagaatcataattttgctgttatggcttatggactcttaacgttattagttggtctcacatcagacattattcggattcgtttggcaagttatgatttagtgaccattcctagtgaattgaaagagcgggttataaaagtcatgacaacttttgccattcgttcagttgtggttcgctttatcatcattatcctcgcttattttctacctgaggtagggatatttgcatatttagtcataccgctctttatgttttggcgtcgctctagagcaggaaaatactatgctaaaaagggcattgaggcaccatcttatatcaagctttttatccaaattggagagagagctcctgaggattttactaattcaagtagtggaataggtggggtaaaaagactctataaaaaataataggagaccttgaaaaaaaggtttctttttgttaaactaatgagaagaaactttatttagggagcaatttatgaattgctataaaagttaatagttaaggtaagaaccagattgttctggtctttttaacacttaacacccgatctattaatttgaggagtgtgtaatgtctgaacgtggtttgctaattgttttctcaggaccatctggtgttggtaaggggacagttaggcaagaaattttttcaacccctgaccataaatttgattattccgtttcaatgactactcgtccacaacgcccaggcgaagttgatggagttgattatttcttccgtacacgtgaagagtttgaagcgttgattaaagaaggtcaaatgcttgagtatgcggagtatgttggtaactactatggaactcctttaagttatgtcaacgagactttagacaaagggattgatgtttttcttgaaatagaagttcagggagcgcttcaagttaaatcgaaggttccggacggtgttttcattttcttaacaccaccagatttagaggaattagaagagcgtttagtaggacgtgggacagatagtccagaagtgattgcccaacgtattgaacgtgccaaagaagaaattgctttgatgagggagtatgactatgctgttgtcaatgatcaagtgtcattagcagcagaacgtgttaaacgtgtcattgaagcagaacattatcgtgtggatcgtgttattgggcgttataccaacatggtcaaagaaactgataaaaaattaagttaaaaatagaaaagagaattgccttatgatgttaaaaccttctatcgacactttgttggataaagttccttcaaaatattctttagttattttacaagctaagcgtgctcatgaattggaagctggtgagaaagccactcaagattttaaatctgtgaaatcaacacttcgcgctttagaagaaatcgagtcaggtaatgttgtaattcacccagatccatcagcaaaacgtgcctcagttcgcgctcgtatcgaagctgaacgccttgctaaagaagaagaagaacgtaaaatcaaagagcaaattgctaaagaaaaagaagacggcgaaaaaatttaagcaagtcaaaagtgagaggttgaaacattctgtatcagcctcttttcatattttagagaattagggagggtttatggcaagaaaattagcacaggttattgttgatattcctctgatgcagacagataaaccattttcgtatgccattcctaaagatttggaagatttggtacaagtaggagtacgcgttcatgttccttttggaagaggaaatcgtcttttgcaaggctttgttgtcggtttcagagatgatgatgaattagagactaaggatattgcggaggtcctagattttgaacctgttttaaatcaggaacaactagacttagctgatcagatgcgccatactgtcttttcttataaaatatctattttgaaatcaatgttaccaagtcttttgaattcgcaatatgataaactcttgttagcaacagacacattaccatcagaagatagagaagatctatttggtcataaaacggaaattgtcttttcaagtttgtcttctcaagatgccaaaaaagcaggcagattaattcaaaaaggtttcatagaagttcaatatttagccaaagataagaaaacaataaaaacagaaaagatttacaaaatcaacagaactctgttagaaaagagccaaatagcagcaagagcgaaaaagagactggagttgaaagaattcctgttagaaaatcctcaaccagggcgcctcacagctttaaacaaacaattttcatctcctgtggttaattttttcagagaagaaggaatcattgaagtcattgaaaaagaagctagtagatctgataattattttaaaggaatcctaaaaacggattttttggatttaaatcaggaacaagctaaagtagttaaaatagttgttgaccaaattggtaaggaacagaataaacccttcttgttggaggggattacagggtctggtaagacagaggtatatcttcatatcattgataacgttttaaagttgggaaaaacagcgattgttctcgttccagaaatttctttaactccccagatgacgaatcgttttatttctcgttttggaaagcaagttgctattatgcactcgggcttgtcagaaggtgaaaaatttgatgagtggcgaaagataaaatcaggtcaagctaaagttgtcgttggagctcgttcagcaatttttgctcctttggaaaatatcggagccatcattatagatgaggaacatgaatcaacttataagcaagaatctaacccaaggtatcatgcgcgcgatgtggccttgctacgtgcagaatattataaagctgtgttactaatgggatcagcaactccaagtatcgaaagccgagctagagctagtcgggatgtttataaatttttagaattaaaacatcgtgctaatcctaaagcacgtattcctcaggttgaaattattgattttagaaattttattggtcaacaagaagttagtaatttcacatcatatttactagataaaatccgagatagattagataagaaagagcaagtggttcttatgctcaatcgtagaggttattctagttttattatgtgtcgagactgcggctacgttgatcaatgtcctaattgtgacatttctctgactttacatatggctacaaagaccatgaattgtcattattgtgggtttgaaaagcctattccaagaacatgtccaaattgcaatagtaaaagtatctcttactatggtactggaacccaaaaagcttatgaagaacttttgaaagttatcccagacgcaaagattttacggatggatgttgatacgacaaggcaaaaaggcggtcatgagtctattttgaagcgtttcggaaatcatgaagctgatattttattgggaacacagatgattgctaagggattggattttccaaatgttactttagttggagtactaaatgcagatacttctctgaatttacctgattttcgatcatcagagcgaacttttcagctattaactcaagtggctggacgtgctgggcgtgctgaaaaagaaggagaggttgtcattcaaacttataatcctaatcattatgctattcaattagcccaaaagcaagattttgaagctttttatcaatatgaaatgaatatccgtcgacaacttggttatcctccttattattttacagttggtttaacattatcgcataaagatgaagagtggttaatacgaaaatcttatgaagtattaagtttattgaagcaaggctttagtgataaagtaaagttgttaggtccaacgccaaaaccaattgcaagaacacataacctttatcactaccaaattattatcaagtatcgatttgaggacaaccttgaacttgttttgaatcgcttattagacatgactcaagacaaggagaatagagatcttcgcttagcaatagaccacgaaccgcaaaatatgatgtagaatagtgctatgatataattgagaaaagaaagacgaggaaaaagcaatgacaaaattattattcatggggacccctgatttttcagcgacggttttaaaaggtattttagcagatggtaagtatgatgttttagctgttgtgacgcaaccagatcgtgctgtaggtcgtaaaaaagaaattaaaatgacccctgtaaaagaagtggccttggaaaacaacattcctgtgtatcagccggaaaaactatctggaagtccagaattagaacaactaatgaccctaggtgcagatggtattgtaacagctgcttttggtcaattcttaccaacaaagcttttggaatcggtaggttttgcaattaatgtacatgcttctctattgccaaaatatcgtggtggggcaccaattcattatgccattattaatggcgaaaaagaagctggggttaccatcatggaaatggttgcaaagatggatgcaggggatatggtatcaaaagcttccgttgagataactgatgaagacaatgtagggacaatgtttgatagactcgccgttgttggtcgtgaccttttattagatacgcttccaggttatctatcaggtgatattaagccgataccacaaaatgaagaagaggtaagtttttctcctaatattagtccagatgaagagagaattgattggaataaatcatcgcgcgacatttttaaccatgttcgagggatgtatccatggccagttgcacatacccttttggagggaaatcgttttaaactttatgaagtaacaatgtcagaaggaaagggctcaccgggtcaagtgatcgctaagacaaagaactcattgacagtagcaactggtgacggagctattgaactcaaatcagttcaaccagcagggaaacctcgtatggatataaaagactttttaaatggtgttggtcgtaatttagaaataggagataaatttggcgaatgattggaaaaagagtgcgcgtggtttagctttaatgactttagaggaagtttttgataaaggagcttattctaatatcgcacttaataagagtttaaaaaaatctagactatcagataaagatcgtgccttagtaacagaaattgtctatggaactgtggctagaaaaataacgctagaatggtatctatcacactttatagttgatcgtgataagcttgaattatgggtatatcatctcttgctactgagcctttatcaactactctatctggacaacatcccagatcacgctattgttaatgatgctgtcactattgctaagaatcgaggcaataaaaagggtgctgaaaagttaattaatgccgttttacgaagagtaagttcggagacgctccctgaaattgcatcaataaaacgccaaaacaaacgttactctgttgcttattccatgccagtgtggctcgtaaaaaaattaattgaccaatatggtgagacaagagctttagctattatggagagtttatttgagcgaaataaagccagtcttcgtgtgactgacttatcgcaaaaacaaactatcaaagaaactttaaatgttagagattcacatattgcagagacagctttagttgcagactcaggaaattttgcatcgacatcatttttccaagatggcctcattactatccaagatgaatctagtcaattagttgctccaacactcaaagtctcaggtaatgaccaagtattggatgcatgtagtgcaccaggaggaaaaacaagtcatatcgcctcatatttgactacaggggcagtaactgctttagatttgtatgatcataaattggaattggttatggaaaatgcaaaacgcctaggtctgtcagataagataaaaactaaaaagttagatgcaagtaaagctcatgagtattttcttgaggatacttttgacaaaattttagtagacgcaccttgttcaggtatcgggctaattcgccgtaaaccagatattaagtacaataaagctaatcaagactttgaagcactccaagagattcaattgtctatcctatctagcgtttgtcaaacgctacgtaaaggtggtataataacctatagcacttgtaccatttttgaggaagaaaattttcaagttattgaaaaattcttagaaaaccaccccaattttgagcaagtagaactgagtcatacacaagaggatattgtaaagagaggctgtattagtataagccctgaacaatatcatacagatggcttttttattggacaagtcaaacgtatcttgtagtgtctaggaggaaactgacatcgtcagaaaaaaatatatggaaatatctcttttaacagatattgggcaacgtcgttccaataatcaagattttattaatcaatttgaaaataaagccggcgtcccactaatcatcttagcagatggtatgggaggacatcgtgcaggaaatattgctagcgagatgactgtaactgatctaggaagtgattgggcggagacagatttttctgagttatcagaaattcgtgattggatgcttgtctctattgaaacagagaatcgcaaaatatatgaattaggtcagtcagatgattacaaaggtatgggaactaccattgaagcagttgccattgtaggagataatattattttcgcacatgtaggagattcacgtatcggtatcgttcgtcaaggagagtatcatttattgacgagtgatcattctcttgttaatgaattggtaaaagctggccaattaacagaagaagaagctgctagtcatcctcaaaaaaatattattacgcaatcaattggtcaagccaatccagtcgaacctgatttaggagttcatctacttgaagaaggtgactaccttgtagttaatagtgatggactaactaatatgttgagtaatgccgatattgctacagtactaacacaagaaaaaaccttagatgataagaatcaagatttaatcactctagcaaaccatagaggaggtcttgataatatcactgtggcactagtttacgttgaaagtgaggcggtttaatgattcagattggcaaattatttgctggtcgttatcggatccttaaatcaatcggacgaggtggaatggcggatgtttatctagctcgagatctaattttagataatgaagaggtcgcaataaaagtattgcgaaccaattatcaaacagatcagattgcggttgctcgcttccagagagaagcacgagcaatggctgagctgacacatcctaatattgtcgctattcgtgatataggtgaagaagacggacagcagttcttagtaatggaatatgttgatggattcgatttaaaaaagtatattcaagacaatgcacccctatcaaataatgaagttgttcgaatcatgaatgaagtcctttcagccatgtcactggcacatcagaaaggtatcgtacaccgtgatttaaaacctcaaaatattttattaactaaaaaagggactgtaaaagttacagatttcggtattgcggtagcgtttgctgaaactagtttaacgcaaacgaattctatgttaggtagtgttcattatttatcgccagagcaggcgcgtggttcaaaagcgactgttcagagtgatatttatgccatgggaatcatgctttttgaaatgttaactggccatattccttatgatggggatagtgcagttactattgccctacagcacttccaaaaaccactaccatcaatccttgcagaaaataaaagcgttccacaagctttggaaaacattgtcattaaagcaacagctaaaaagctaacagatcgctataagacaacttatgagatgggacgtgatttatcaactgctctaagctcgacacgtcaccgtgaaccaaaacttgtttttaatgatactgagagtactaagacactacccaaagtaacatctacagtatcatctctaacgacagaacaactgttgcgtaatcaaaaacaggccaaaacaacagaaaaaataactcctgattctgcgagtaacgataaaacgaagtctaaaaagaaggcttctcatcgacttcttggtacaatcatgaaattattctttgcactctgtgttgtaggaataattgtatttgcttataaaattttagtaagtcctacgactattcgtgttccagatgttagcaacaaaacagtagctcaagcaaaaatgacattggaaaattctggattgaaagtaggagctattcgtaatattgagagtgatagtgtttcagaaggacttgtcgtaaaaacagaccctgctgcaggacgttctcgcagagaaggggctaaagttaatctttatattgccactccaaacaagagtttcactctaggtaattataaggaacataattacaaagatatcctcaaagatcttcaaggcaaaggtgttaaaaaatctttaatcaaggttaagcgtaaaattaataatgattatactactggtacaatcttagcacagtcgcttccagaaggaacatcttttaatcctgatggtaataagaaattaacacttacggttgctgttaatgatccaatgattatgcctgatgtaacaggtatgactgttggagaagtaatagaaaccttgacagacctcggattagatgcagataatcttgtcttctatcaaatgcaaaatggcgtttatcaaacagtagtaacacctccatcttcaagtaagatagcaagtcaggatccttattacggaggagaagttggattaaggagaggagataaagttaagctgtatcttcttggttctaaaacaacgaataactcatcatctacgccaatagattcttcggcttcaagctcaacaggaacaactacctcggattctgtaagctcatcaacggatgctagcacttctgatagtagtagcacttctacaagtagttcaacactaccaagtgatagtacaactaatacaggaacagctaacaatccattaactcaataaaattaaaaagaagatgttaaagtcttctttttaatttgctatggcagagaccatgcctagaaaggttctctgccaatatgccaaatttttctctcaataatggtgcaaagtatagggctttttgataaaatacgtcatatagagtaatggaaggattattatgaaaaaatttcagttttttctacttgttgaagccgttgtcttagttatgggattaatgaaaattttatctgatgactggacaagttttatttttattctcgctttgattcttttagccttaagattttataacaacgatagtcgtcataattttctgttaacgacaagtttgttattactatttttaatctttatgcttaacccttacattattgcagccgttgtttttgcagttttgtatgttctaatcaatcatttctcgcaagttaagaaaaaaaatcgttatgctttgattcaatttaagaatcatcaattagatgttaagacaacacgaaaccaatggttaggtactgatcaacacgaaagtgacttttatgcttttgaagatattaatattataagaatctctgggactgatacaattgatttaacaaatgttattgtatctgggcaggataatgttattataattcaaaaagtttttggtgatactaaagtattggttcctttagacgttgccgtaaaggctgatattagttctgtttacggtagtgtacagtactttgattttgaggagtatgatctaagaaatgaatctataaaattgtcacaagaggaagaatattaccttttgaaacgtgtcaaattagttgtaaacactatcgctgggaaagttgaggttagtcgtaaatgaaaaagcaccactactttttagctttcttctatggaagtgtcattatatttgccatttgttttgtcattattgatagtttgggtgttaatttggtgcacctctatcaaacgtctcgtttgtggctgattgaacaattgattttctctattttctttctatctttagcggtaactatccttttattgctaacttggtttttattagatgataatagtaaacgtcaaattaaccataatttacgtcgcattttaaataaccaatcaataaatgttaccgatgatggtactgaaatatcgaccaatattcaacggctctctaaaaaaatgaatttaatgacagcaagtctacaatctaaggaaaatagtcgtattttaaaaagccaagaaattgtgaaacaagaacgtaagcgtattgcacgtgatttacacgacacagttagtcaggatttgttcgctgcttccatggttttgtcagggatagcacagaatgtttctcagctagacgttgatcaggttggctcgcaattattagcagtagaagaaatgcttcagcatgcacaaaatgatttgagaattctgctacttcatttgaggccagttgaattagaaaataagaccctatctgaaggattcagaatgatattgaaagaattgaccgataagagcgacattgaagttgtttatcatgaatcaattctaaccttacccaaaaagattgaagacaatatttttagaattggtcaagaatttatcagtaatactttaaagcattcacaagccagtcgtctcgaagtttaccttaatcaaacagagaatgaattgcagttaaaaatgattgataatggtattggatttgatatggattctgtctatgatttaagttatgggttaaaaaatattgaagatcgagtagaagatttagcaggaaatttacagcttctcagtcagcctggtaaaggagttgctatggatataagattacctttagtaaatcagagtgaggataaaaatggataaaataaaaattgtacttgttgatgaccatgagatggttcgtctcggtttaaaaagttttttaaacttacaagctgatgttgaagtaataggtgaggcctcaaatggtttagaaggcataaaaaaagcactggagttacgtccagacgttgttgttatggacttagtaatgcctgaaatggacggtgtagaagcaaccttagcattattgaaggattggccagaagctgccattttagtcttaacatcttacttggataatgaaaaaatttaccctgttattgaagcaggtgccaaaggctatatgttaaagacctcaagcgcagcagagattcttaatgccattcgtaaagtttcaaggggagaacaagctattgaaaatgaagtagataagaaaattaaggctcatgataaatgtccagctttacatgagggcttaacagcaagggaacgtgatatccttaatttattagccaaaggttatgacaatcaaaggattgctgatgaattatttatctcgttaaagactgttaaaactcatgtttctaatattttgggaaaactaaatgtagcagatcgaactcaagcagttgtctatgctttccaacaccatttggtaccacaagatgatgaataagtgatataatagaggcactatgttaatgaaagtggttagtcatggacgcaaaaactaaatataaagcaaaaaaaataaaggcagtgttttttgatattgatgacacgcttcgtgttaaagatacaggttatatgccaccatcaatcttaaaagtttttaaagctttgaaagataaaggaatcgttgtaggtattgcttcaggaagagcacgatatggcgttccaaaagaagttcaagatttaaatgccgattattgtgtaaaattaaatggagcttacgttaaggacaaggataagaatattatcttccatcgtcctattccagctgaatatgtagagcaatataagaaatgggcggacactgttggtattaagtacggtttagctggtcgtcatgaggcagttttatcagatcgtgatgatttggtaaatgatgcgattgatattgtgtattctgatctcgaagttaatccagatttcaataaagaacatgatatttatcagatgtggacatttgaagataaaggagatagccttcatctacctgaaccgttagctgaacatcttcgcttgatacgttggcatgatcattcttcagatgttgtgttaaaaggaacatcgaaggctttaggtgtttctaaagttgttgaacatttgggcttaaagccagagaatatcttggttttcggagatgagctcaatgatttagaactctttgattatgctggactagctgtggcgatgggagtgtcacacccagaagctcaaaaaaaagcagattttatcacaaaaaaagtagaagaagatggcattttgtatgccctggaggaactaggtttgatagaaaaagaattaacatttccacaagtagatattgaaaatacagaaggtcctgtggctgtcattaaaacaaatcacggggatatgactgtaaaactcttcccggatcatgctcctaaaacggtagcaaactttattggtttagctaaacaaggttattatgatggtattatcttccatcgtattattccagattttatgattcagggtggtgatccaactggtacaggtatgggtggtgaatctatctatggggaaagttttgaagacgaattttccgaggaattatataatgttcgcggagctctttcaatggctaatgctggaccaaatacgaatggcagccaatttttcatcgtccaaaatacaaaaattccttatgcgaaaaaggaattagagcgaggtggttggccaacaccaattgctgagttgtatgctggacaaggtggtacaccgcatctagatcgtcgccacagtgtatttggacaattagtagaccaaagttcttttgaggtacttgatgagattgcggcagtagagactggttctcaagacaaaccattggaagatgttgttattttaacgattgaggttaaagaataaaatgaagattggcgataagttaaagggaacagtcactggcattaggccttatggagcctttgtttctcttgaggatggtaggactggacttatccatatttctgaaattaaaacaggttacattgataatatttatgatgttcttagtgtaggtgatgaagtctatgttcaggttatagatgtagatgaatttacacaaaaagcaagtttatcgcttcggacccttgaagaagagagacatcatattcagcatcgtcatcgattttctaacaatcgtcttaagataggtttcaaaccacttgaggaaaatttacctagttgggttgaggaaggtctagcctacttgaataataaataaacaaaaaacctagatttgattaatgacaagtctaggttttaaatatttaaaagtagcagtgaatattatacttgctaaaaatagcttgataatcgagtagatcctctgggtgtagtgcagcgatctcttccatttcatattgacgattaagtaattgatatttgttttgcccaaattggtggaaaggtaagagttgcacttgacggatatctaggcgatcaaataaacaagcaaattcttcagcatcttctaatgaatcgttaaaattaggtatgacaggaatacgtagcacaatcgttttaccgttggcaaaagcataatgaatgtttttgatgattgaagcattcttaaccatcgtcttttcttggtgtttgaggctattgtaatgttttaaatcggtgtaaataaaatcaacgtattggataagatctatgaattgttcatgtctagtataagcagttgtttcaatagccgtgtggattcccagtgatttagcacgttttaaaattgccttggcaaattcaaattgtgcaaatatttcaccgccagatagcgttatgcccccaccagattcttcgtaaaaatcaatatcttttaaaacttcttcaataatatcatcaaccgatttttcttcgcccacgatgacgctttcattagtaatggcatctctcattgtttctggaaccattttttgcgactcgggattagcacaccaaggacatctaagaggacaaccctttaagaaaacggttgttcgaatacctggaccatcgtgaatactaaaatgttgaatgttgaatacaatacctttttcatttgtcatattattttcctcaatttcattttaagtataccttttatacgtaacaaagtcaattacgaatgaaagtttattgaacttgtttaataaataaaaaatgataaaatagaaaggaggtgtttcatgaatagattagaaaatattattagtttagtatcccagtaccaaaaaatagatgttaatacactctcggagttgttgcaagtttctaaagtaacgatacgtaaagatttagataaactagaaggcaaagggcttttgcatagagagcacggttatgcagttttaaacagtggggatgaccttaatgttaggttatcttttaaccataaaactaaaaaagaaattgctgccttagctgcaaatatggtgtctgacaatgacactatcttaatagaatcaggctctacttgtgctcttttagcagaaaatatctgtcagacaaagcgaaatgtcactattttgaccaactcttgctttattgctaactatttacgagagtatgattcatgccaaattgtcttacttggtggtgagtatcaatcaagttcacaggttacggtaggtcctctcttgaaaaagatgatttcactttttcatgtctcgttagcttttgttgggactgatggttttgatccaaaactaggatttatgggtagagatttaatgcgttctgaagttgcacaagagatggcgaatgctgccgatgaagtcattattttaacagattctagtaagtttaatcagactgcattggtggaacagcttccgttgtcaactgtatcacaagttattacagataaacatccaaattcggaaattgctaatttgttccaagaagcagagattaccattcaatctttattacaagtaccataaaagaggctatttttcttacattttgcacatttgtggcgataatagataaagtgtcatgtcaaattgcacagatgtaacctttttgttaaactgaagcaaatgctgaaaggttatgagtatgaaattagagcgtcaaaaattgttagctaaagtagcttacctttactatatggaagggaaaagccaatctgagattgccaatgaattaggaatttatcgtacaacaataagtcgtatgttagccaaagcgagagaagaaggtcttgttagaatcgaaatttcagattttaatccagaaatttttcagttagaatcctattttaaaagtaaatatcaccttaaagatattgagattgtttcttcgcgaaaagatagcgatacttcagagatagagaaggatttagcacatgtagctgcagctatgattcgaaaaaaaattaaagagaatgacaaggtggggattgcttgggggaggacacttagtaaagtagttgaagcaatgcgtcctcatccggtttctcaagtttcttttgttcctttggccggaggtccaagtcatattaatgcacgctatcacgttaatactctggtttacgaaatgtcaaggcgtttccaaggaagttgtactttcattaatgcaactctagttcaagaaaacgctaatttagcgaaaggaatattaacttcaaaatattttgaggggctaatggataattgggaaaaacttgatgtggcaattgtgggcgttggtggtaaacctaaaagcaatgaacaacagtggcttgaccttttaaatcaagatgattttcaatgcttggatgaagaagcagctgtaggtgaaattacttgtcgtttttttaatcattcaggtgatcctgtgaatcaacatttagctaaaaggacaataggaattaccttagaacaactacagaaagttcctaatagaatagcggttgctcatggcaattataaggctgcggcactcttagccgttttaaaaaaggggtatattaatcatttagttactgatttttccacagccttaaatattttaagattagataaagacacctttgtggatactatatatcaaaagagctaggaataaatcctagctcttttgataatgtttctattaccaagtgaattgttatagaataagcacaaaggtgcgctattgtcataaagggcacaaagtctattgacgatgattaagggacatgttacatttgttttgcgaaagaaaactagaaccttttgtaagaaagtttaaacttataaaaaatcattaaagcggaggtgcttatggaaatcatagtcgcagaccaaattattatggggctcattttgaatgctggggatgctaaacaacatatctatcaagccttaaaacttgcaaaagaaggaaattttgcagaaagtaagattgaaatagaactagcagatagtgcactcctagaagctcataatcttcaaacacaattccttgcacaagaagcaggagggacaaggacagatatctcagcactctttattcattctcaggatcatttgatgacaagtattactgagattaacttgattaaagaaattattgatttacgccaggaattacatattcaaaaataagtaaaggggatcaaatatgataaaaattggtttattctgtgcagcaggtttttcaacaggtatgttagtaaacaatatgaaaatcgcagcggataaagaagggatagaggcacatattgaagcttattcacaaggaaaaattgcagattatgctaaagatttagatgttgcattacttggtccacaagttagctatactctagataaatcaaaatcaatctgtgatgaatacggtgtaccgatagcagttattccaatggcagattatggtatgttggatggtgtaaaagttttgaaacttgctttgagtttattggaaacaagaaaagaggcttgatatgtcaaagtttgatagtcagaaaataattactccgattatgaagtttgtcaatatgcgagggattattgcactcaaagatggcatgctagcaattctaccactaacagttgttgggagtctctttttaatattagggcagcttccatttaaaggtcttaatcaagccatagctaatgtttttggaccagaatggacagaaccatttatgcaagtttattcaggaacttttgcgattatgggcttgatttcctgttttgcaattgcttatgcttatgctaaaaatagtagtgtagaaccgttacctgctggcgttttatcactttcgtctttctttattttaatgaaatcatcttatattcctgtaaaaggagaagcaatagcggatgctatttctaaggtttggtttggcggtcaggggattattggagcaattattattggcttagtagttggtgctatctatacatggtttatccaacatcatattgttataaaaatgccagagcaagtaccacaggcaatagcaaaacaatttgaagctatgattccagcttttgttatctttcttttatcgatgattgtttatttgattgctaaggtaacaactggaggtacctttattgagatgatttatgatatcattcaagtaccgttgcaaggcttaacaggctcactttatggagcaattgggattgctttctttatttcattcttatggtggtttggtgtccatggccaatctgtggtgaatggtattgtgactgctttgttactatccaatttagatgccaataagtctttattagcagcaaatcgcttaacattagataatggcgctcacattgtaacacagcagtttttggatagtttcttgattttatcgggctcaggaataacttttggactagttattgcgatgctttttgcagcaaaatcaaaacaatacaaggcacttgggaaagtggccgcttttcccgcaattttcaatgttaacgagccaatcgtctttggctttccaatcgtaatgaatcctgtgatgtttctgccttttattttagtaccagttttggcagctttaattgtttatggagctattgcggttggttttatgcaaccattctcaggtgttactttaccatggagtactccagcaattatttctggattcatggtaggtggttggcaaggtgcactcgtccaaatagtcattttagctatctcaactgctgtttacttcccattctttaaaatccaagataatattacttacaaaaatgaatgtgaaatggaaaggggatagctagcagataagaggttgaggtgtgtaatgcaccttaacctttttctaaaaatgcacatttgtgcaactttagatgtagcattctattctttattttcttcttgttattttaggatttaggtgctattatatttacgaagaaaaactttttagtttcgaaagaaacaagcggaggctgttatgaccaaacaattactcactcaaaaatatacaaatgatgttcaacaaaattctcaaaagcattttggctatttgacagagcgcatgtattcttatcgcgataaggttcttgataagaaaccattcatagatgcagaacgtgctatcttggtaactgaagcctatcaaaagcatcaggaaaaacctaatgttttaaagagagcttacatgttgcaaaatattttggaaaaaatgacaatctatattgacgatgagacaatgattgtcggtaaccaagcttcatctgataaagatgctcctatttttccagaatacactctagaatttgttgtaaatgaactagacctttttgaaaaacgagatggtgatgtcttttacattacagaagaaaccaaagaacaaattagaaatattgcacctttctgggaaaataataatttacgggctcgtgcgggcgttatgcttccagaagaagttcaagtttatatggagacaggcttctttgggatggaaggtaagatgaattctggggatgctcacttagctgtcaactatcagaagttactagaagaagggcttattggctttgaaaaaaaagcaagaaaagctaaagctgacttagatttaacaaagcctgagagtattgacaaatatcatttctatgattctattttaattacaatagaagctgttaaaacctatgcagagcgttttgctatcctagcaaaaaaacaagctaaaacagcaaatgctaagagacgtcaggaattgttagatatcgctagtatttgtgaacgagtgccctattacccagctgaaacgtttgcagaagccgttcaatcggtttggtttattcagtgtattcttcaaatagaatcaaacggtcattctctatcttatggacgctttgatcaatacatgtatccatatgttaaatctgacttagaagctggacgtgagactgaggattcgatcgttgagcgcctaactaacctatggattaaaacaataactattaataaggttcgtagccaagctcatacgttttcgtctgctggtagtcctctttaccaaaatgtaacgattggaggacaaacacgacataaggaagatgctgttaatcctttatcatttctagtactaaaatcagtcgctcagacacacttaccacagcctaatctaacggttcgttatcatgctaacctagacaagtcattcatgaatgaagctattgaagttatgaaattaggctttggtatgccagcttttaataatgatgaaattattattccatcatttattaaaaaaggagtttccgaagaagatgcctatgattattcagcgattggttgtgtcgaaacagcagttcctgggaaatggggttatcgttgtaccggcatgagctatatcaacttccctaaagtgttattaattacaatgaatgacggtattgacccggcttctgggaagagatttgcgccttcttatgggcatttcacccagatgacctcatataaagaacttaaagaagcttgggacaaaacacttcgttacttaactcgaatgagcgttattgttgaaaatgctattgatattagtctcgaaagagaagtacctgatattctttgttcagctttaactgatgattgtattggacgaggtaagcacttaaaagaaggtggtgcagtatatgactacatatctggtctacaagttggaatcgctaatctttcagactcacttgctgcgcttaaaaaattagtatttgaagaaaaacgcctaaccacattagaagtatggcaagcattgcagagtgattacgcaggtccgcgtggtgaagaaattcgtcaaatgttgatcaatgaagcaccaaaatatggaaatgatgatgactacgcggatagtttagtacgtgagtgttatgatgtttatgttgaagaaattgctaaatatcccaacacacgctatggacgtggaccaatcggtggtattcgctattcaggaacgtcctctatttcagcaaatgtaggccaaggacgaggtactttagcaactccagatggtaggcatgcaggaactccattagctgaaggttgttcaccatctcataatatggacaaaaagggacctacctctgttttgaaatcagtttcgaagttaccaactgatgagattgtcggcggtgtactccttaaccaaaaagtcaaccctcaaaccttggcaaaagaagaagataaacaaaaattaattgccttacttagaacattcttcaatcgccttcatggttaccatatccagtataatgttgtctcacgtgagactttgattgatgctcagaagcaccctgaaaaacaccgcgatttgattgtgcgtgtagcaggttattctgcattctttaatgtcctatctaaggcaactcaagatgatattattgcacgtacagaacatgctctttaggagattattatggaatttttacttgacactttaaatttagaagctataaaaaaatggcatcatatactgccactagcaggtgtaacttcaaatcccaccattgctaagaaagaaggagatatacattttttccaacgcattcgtgatgttcgagaaattattggacgtgaagcaagtttgcatgttcaagtagtggccaaagattatcaaggaatattggatgatgctgctaaaatacgccaagaaacggacgatgacatttatatcaaagtcccagttacgccagatggattagcagcaattaaaacgttaaaagcagaaggttataatattacagccacagcaatatacaccagtatgcaaggtcttttggctatatcagctggagcagactacctagcaccttactttaaccgaatggagaaccttgatattgatgcgacacaagttattaaggaattagcgcaagcaatagagcggacaggttcttctagcaaaattttagcagctagttttaaaaacgcttcacaagtaacgaaggccttatcacagggtgctcaatcaatcaccgcgggaccagatatttttgaatcagtctttgcgatgccatctattgcaaaagctgttaacgactttgcagatgattggaaagccagtcaacactcagaacatatttaacagagaacgccaacttttgaggctgtatctttaacataaaattttttaaagaagaaagaggttgagaatgaaagttttcgcaagtccatcgcgctatatacaaggaaaggatgctttattccaaagtattgaacatatcaaatctttaggtcagactccacttatcctttgtgatgatgttgtttataatatcgttggagaaaggtttttatcttatctacaagacgatttgttaccacatcgtgtttcctttaacggagaagcatctgataatgaaatcaatcgtgtcgttgctgttgcgaaagaaaagaatagtgaccttattattggacttggtggtggaaaaactattgactctgcaaaggcaattgcagataaagttaatttaccagtggtcattgcaccaacagtagcttcaacagatgccccaacatcagcgttatcagtaatctatacagatgaaggagcttttgaaaaatatattttttattcaaagaatccagacttagttttagttgatactcaagtaattgcccaagcgccaaaacgtttactagcttctgggatagcagatggcttagctacttgggttgaagcgagagcagtcttacaaaaaaatgggatagcgatggctggcggtagacagactttagcgggcgtggcaattgcccaagcatgtgagcgtactttatttaatgatagtttacaagctttagcggcttgtgatgccaaagtggttacaaaagctttagaaaatgttattgaagctaataccttacttagtggtttaggttttgaaagtgcaggattagctgcagctcatgctattcataatggttttactgccttgagtggagatattcatcacttaacccatggtgaaaaagttgcctatggaacgttgacgcaacttttcctcgaaaatagaccaaaggaagaaattgatcgctacattaatctttaccaagcgattggaatgccaactacacttgcagaactccatttgggtgatgcaacatatgaagaacttttaaaagttggtcagcaagcaacaattgaaggtgaaacaatacatgaaatgccattcaaaattagtgcagaggatgtcgctgcagccctgttaacggttgaccgttatgtttcaaatcatcaataaaaacaatagaaccaagtgaaattgcttggttctatttgtcgttttaatattttaactaaatagggcttactagtatttaaagagatataaactaaaaaagatcagacaacatatctaatcttttttagttatcgtttactgaagattaaagttattcaaaatcatacaggcttgttgataagtaacgttcgccattatcagggagaagagctaaaacctttttcccttttcctagttgtttggccacttcaatagcagcataaatagcagctgaagcagaaattcctgcgaggaaaccttctagtccgccgatgatacgtcctgtttcaatagcatcgtcagatgtaacgcgaatgatatgatcataagaatctgtagccaatgtttctggaatgaaacctgcagaaatcccttgtattttatgaggcccaggttgctcaccagaaaggattgcagattcatcagcttctacagcataaatagcgacatcaggattgactttttttaatgcacgagagacaccagtaattgtcccaccagttcccacacctgcgataaaagcatctaaacctttttcaccaaaagtctcgataatttccctaccagtcgttttttcgtggatttctggattggcttgattattaaattgcaggggtagccaagcattttgctctgcagaaatttcttttgccttagcaatagctcccttcatcccttcactaccaggtgttagtactaattgagcaccataggcttgaatgattttacgacgttcaattgacatggtttctggcataacaataataacattataccctttagcttttcctacccaagccaaaccgatacctgtattaccagatgtaggttctacgattgtatctccggctttaagaatccctttttgctctgcatcttcaatcatagctagagcgatacgatctttgacagatgaacctgggttaaaggattctaacttaacgtacacctctgcagctccttctggaacaatatgatgtaattgaataatgggtgtatttccgattaagtctgtaatagaattataaatttttgacataagctatacctcttcatgatattggttaagaatattataaaactcacattgattaaagtaaaatatcaattctttatcaagtgatagctattatttatcggtttcagccttaaagggaatttcaacaatttgactcccttcttcagttaacaaagcttttccttggtagaactctgtcaaattagttattgtgtgttcaaattccttagggtcaacgtatattttacaggttacagcttctaaaaattctgtttcaaactcctgaaggtggtgctcttttaggaagttgtcaaaagtttgatattgaggataagttaattgaatacgaataccaatttgttctttaacttctactaccccgatctctttgatggtattagctacgctaccagagtaggcacgaataagcccccctgcgcctaatttgatacctccaaaataccgtgtaacgacggcaacaacatttgtcaggccttgcttttcaagtacggttagcatagggatacctgctgtaccactaggttctccatcatcactagatcgttttatatcccctttttcgccaataaccatagctgaacacgaatgattggctttgtagtgcgctttcttgatttgcgtaatataattacgcccctcctcttcggactctactcgctttagatgacaaataaatcgcgattttttaatttcttcttcgacaattccgtctgattttatcgttttatagttcatagagaaattctacaaaaattcttcaaatttagcaaaaaaatccgaatgaaataatatggaaaattatttaggtaggctttggacaaaagcacaattatctgagcaacttagaaaaattgcaattagcttgccatcttttataaagaaaggaagcgactatatttgtacccgatgctctagttctgttgctaaaaattgccaattaccaactggaaattattattgtagagaatgtatagtttttggaagagttactagtaatgaaaatttatattatttcccacaaaaaacattttctaaaacgaattctttaaaatggaaaggggaactgacaccttatcaaaatgaggtttcagaagagttgttgaaaggtatttcaagtaaggaaaatcttcttgttcatgctgtgacaggggctggtaaaacagaaatgatataccactctgtcgccaaagtaattgatactggaggaagcgtttgtattgccagtcctagaattgatgtttgtttagaattgtataagcgactttcaaacgattttagatgtgccataacattaatgcatggagaatctccttcttatcagagatcccctttaactattgccacaacacatcaattgttaaaattttatcatgcttttgatttgctaattgttgatgaagttgatgcttttccgtatgtcgacaacccgatactataccagggtgtaaaacaggccttaaaggaaaacggaacaagtatttttctgactgcaacttcaacgactgagttagaaagaaaagttgcaagaaaagaactaaaaaaattgcatctagctaggagatttcatgccaatccgttagtgatacccgagatggtttgggtaagtggtatccagaaaagcttgcagacacaaaaactacctcccaaattatatcagttgataaataaacagcgacaaacgagatatcctttgttattatttttcccccatatttcagaaggtcaggtattcaccgaaattttaagacaagcctttcctatggaaaaaattggttttgtttcaagtaagagcacatctaggttaaagttagtgcaagattttcgagataacaaattgtctatcctagtgtcaactaccattctagagagaggagtaactttccctagcgtcgacgtttttgttatacaagcaaatcatcatttgtttacgaaaagttccttggtacaaatttcaggaagagttggaagagcattagaaaggcccgaagggctcctttacttccttcatgatgggaaaagtaaatcgatgcaccaagctataaaggagattaaaaacatgaatcatataggaggattttaatgacttgtttgttatgtcatgaaatagatttatcgcaattaacttttgtggaacttatgcttctaaaaccaaagcaaaacgtaatttgtcaaacgtgcaagggtagttttgaagcacttagtagggagatgggttgccaaacatgttgcaagcaaattccccaaaaacaatgtcaagattgtatttattggggtaaaaaaggtatagaggtaaatcatttttccctttatagatacaatgaagcaatgaaaaaaaatttttctctttttaaatttcaaggggattatttgttgaaagatgtttttacaaaagaaataaaagctgctctaaaaaagtataagggctacactatagtgccagttcccttgagtcatgaaggataccaaaataggcaatttaatcaagtgattgcttttctacaatcggcaaatataccttacaaaaatattctttctaaaaaagatggaggtaagcaatcggctaataataaagaagaaagactcaaacaagttcagcaatttacattaaaaaatgaggctgagttaggggacaaccttttaattgttgatgatatttatacaacaggcgcaacaatagcacaaatcaggaaactattagaagaaaaaggtataaaaaatataaaaagtttttcattagcacgctaaaatcttgcaaattttcatgaaagcggttataataagagtatagaaagcgttaacaacgcaagaaagaggtactcatatgattaaatacagtattcgtggtgaaaacatcgaagtaacagaagctattcgtgagtatgttgagaccaaactctctaaagttgaaaaatactttaatgaagcacaagaattagatactagagtcaacctcaaagtatacagagagaagaccgcaaaagttgaagtaacaatcttaatagattctattactttacgagcagaagatgtttcacaagatatgtatgggtcaattgacttagttgttgataaaattgagcgtcaaattcgtaaaaataaaactaaaattgcgaaaaaatatcgtgaaaagattccagcaagtcaagttttcacaacagaatttgaggctgagccagatgaagaagcagtaagccaaagaattgtacgtactaagaatgttaatctaaaaccaatggatgttgaggaagcattgttgcaaatggaacttttaggtcatgatttctttatctatacagatgcagaagataatacgacaaatgtcctttacaagcgtgaagatggcgaactaggtttaattgaagctaaaggaaattaactttgtaacataatttaaaaaatctcagggttttctctgagatttttttaaaacctattgacaacaaataaaaaattatagtatactaaatgagttcttaagcgaacctaatattgtattatcattttataaacaacttaaaaaaagtagttgacaaagcagaataagtttgctagaatatagaagttgtctcaagagaggcaaagacctttgaaaactgaacaagatgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagctataatccgccatagctcagttggtagtagcgcatgactgttaatcatgatgtcgtaggttcgagtcctactggcggagtagataaagggagactaactttggttagcctttttttattggaattattatccttaagattggctaacatcttaattgtccgaatttgtcactgataccaagtggttacgattaaaagtggaaaaactatcctatgttctaaataaaatcgtcctaagtaagcttacttaggacgatttgttatctatctaatagtgtaagtagtgtaataggtactatttttggaagaatgtttcatatagtgctttaatagctcttttttcatccttactgtttataacgaacataatggagacttcgcttgaaccttgtgatatcatggtgatattgattttttctcttgataaggcttgtgtcgctgttgcagtgactccaatctgacttttcatattttcacctacaattacgattgtagatagattgtgttggatgtcaacgtaatctacttctagtttacgagttaggtaatttaagatttcttgttctttgattggtgtcaattctttttcacgtaagacaatggatagatcatctatgccagttggcatatgttcaaaactaatatttaaatcctctaaaatttgtagtacttttcggccgaaacctacttctctattcattaagtatttagatacgtttatgctagcaaaacggctatcagaagcgatcccagttactgctatgttactacgagtatgctttaaaactatttttgtaccaggctgttggggattatttgtatttttaataacaagagggattctgccacgataggcaggaagtaaagcttcatcatgtaaaaccgaaaaacccgcataggctaattcacgcatttctttataagtaagctcagggatagcgtgagggttcttaactacacctggatgtgctgcaaatataccatcaacatctgtgaagttctcataaaggtctgcttttatgcctgctgcaattagggatccagtaatgtcagatccccctcttgaaaaggtacaaatttggttatcttctgtgactccaaaaaatccagggataacaagaacctcattgtatagacataagttctcaatcttatcataacttcctggaataattcgtgcattacatggttctttagttacaataattcctgcttcgtttggatgaacatatcttgcaggaatgtcattttgattaaaaaacgttgcaactaactttgcgttgttatcttcaccggctgctaaaaaacaatcatataaaaactgattattttctatgggaagtgaagctagctgctctatagagcgagtaatttcttctgcaatagtgcttcctaaagacaaatcactaataatttcttgataacgattgataatccaagtttggtctttaacaatatctttaccgttaatataattttgataatattgtatcaaagcatctgtcatttttaagtcttcttcgtagcgtttccctggagctgaaacgacaacaaaccgtctagtgtagtctgatttgataatatttagtactttgtataattgttgggaagatgctaaagaacttcctccaaatttgactactttcataggttacctcaagaatgaattttagataaattataacaaaagtcagaaaatttgtcattacctctaaatttaaaagaatgatataatagttacatgtgtaaatataaagcaataatatttgatatggatggtgttctatttgacactgaattattttattataaaaggcgagagcgttttttaaaacaacatggaattacaattgaccatttaccaatgaatttttttattggaggaaatatgaagcaggtttggaaatctgttttaggtgatcaatatgatacctgggatattgataagctccaacaagattatagtcgctataaagaggataatcccttgccatacaaagatttaatttttcaggattgtaaaagagtcattgaaaagcttcatcacaaaggctatcttttgggtctagcttcaagttctactagacatgatatcatgttagcattagaaagttttaatctggatacatattttaaggtaattctgtctggtgaggaattttcagaaagtaaacctaatccagctatttataatagagcagcagaacttttagatattcctaaacagcaaattcttattgtagaagacagtgagaaggggattacagctggtattgcagccggtattgatgtgtgggctattgaagataaatactttggaatgaatcagtcgcaggctaatgtattagtgagcgatctgagtcaattttttgtgaaattagataactattaaaaacgggaagtttaattccgtttttttattttttatcttgccatgaaagctaggtttatgataaaatacaaagcatgataatttgataatcaaattattttttatttttctttcactcttaaagagaggagacattttgaagttcgaaaatataatatatggtattgatggcaacgtggccactattatgcttaatcgaccagatatttcaaatggttttaacatcccaatgtgtcaagaaattattgatgcaataaggcttgtgtctgaaaataaagatgtcatgtttttagtgattgaagcacaaggaccaatcttttcaatcggaggagatttaaaagtgatgaaagctgctgttgagagcgatgatattagctcattaactaaaattgctgagttagttaatcagatatcgtatgatttactacagctagagaaacctgttgttatgtgtgtagatggggctgtagctggtgccgcagctaatattgcattagcagctgattttgttatcgcaagcaagaagagtaaatttatccaggcttttgtgggtgtcggtttagctccagatgcaggaggtttattgttacttagtaaatcaatcggtataactcgtgcagtgcaactagctttaactggagaaagcttatctgctgaaaaagctgaagctttgggaattgtttataaactttgtgaatcagataaaataggtaaaattaaggatcaactattaaagcgtttaagtagacattctataaactcatatcaagccataaaatcattagcttgggaagctgcttttaaagattgggaacaatataaaaagcttgaattacaactgcaagaatcattagcctttaagcaagattttaaagaaggtgttcgggcacacgctgatagaaggcgtcctaattttttaggcaaatagtttgaaaatcaaattatttaagattaaagtcttgcaaataagtttgaactttgatataatttgattatcaaagtttaatgtgaggtggtgatatcttggaatacgatcagattaatagttatttagttgacatttttaatagaatcatgattattgaggaaatgagtttaaagactagccaatttagcgatgtatctttaaaagaaatgcatactattgaaattattgggaaacattctgaggtaactcctagcgatgtcgctcgagaattaatgttaactttgggaactgtaacaaccagccttaataagttagaaaaaaaaggctacattgagcgtaaacggtcaagtattgatcgtcgagttgttcacttgagtcttactaagagaggtaggttattagatcgattgcatagtaaatttcataaatctatggtatctcatattattgaagacctaggtgaagaagacataaaaatgttgacgagcgctttagggaatcttcataaatttttggaggacttagtctagtggtttttgctaaaattagtcaacttgcacattatgcaccttctcaaattattaaaaatgaggatttatcattaatcatggataccagtgatgactggatttcgtcacgtactggtataaaacaacgtcatattagtaaaaatgaaacaacagctgatttggcaaataaggtcgcagaacaacttattgaaaaatccggttattccgctagtcaaattgactttattattgttgcaacgatgacaccagactctatgatgccttctactgctgcaagagtgcaagctcatattggagcgagtaatgcttttgcctttgacttgagtgcagcatgtagtggttttgtttttgccttgtctaccgccgaaaaattgatatcatcaggtagctatcaaaaaggtttagtaataggagcagaaactgtttctaaagtattagactggactgatagagggacagcagttttatttggagatggagctggaggtgtcttgctagaagcttctaaggaaaaacattttcttgcagagtctctcaatacagatggtagtcgtcagggacttcaatccagtcaagtcgggttaaattcacctttctcagatgaagtacttgatgataaatttttgaaaatggatggtagagcaatctttgattttgctatcaaagaagtttcaaaaagtatcaatcatcttatagaaacatcttatttggaaaaagaagatattgattatcttttcttacaccaagcgaatcgaaggattttagataagatgtctcgaaaaattgatatagcacgtgataaatttccagagaatatgatggattatggtaatactagtgcagctagtatccctattttactttcagaatcttatgagaacggtttgttgaaactagatggtaaccaaacaatcctcttatcgggtttcggtggaggtttgacatggggaagtctaattgttaaaatttagttatatatagtgcatagcacatttataaaagattatttaaaatttaaggagctaaaaatggcagtatttgaaaaagtacaagaaattattgttgaagaacttggtaaagatgcagaagaagtaacgttgaacactacttttgacgatcttgatgctgattcgcttgatgttttccaagtgatttcagaaattgaagatgcatttgatatccaaattgagacagaagaaggactaaatactgttggtgatttagttgcttatgttgaagaaaaagtaaaataattaagtcgtaagaaaaaaagaagcaagtgataataaaagatattcttaccaaatcacttattagagtgagtattcaatcaatcgttgatcggtactcactcttcttcttatcaatatagtttgattgtcaaattattaattttaggaaagaaaaatgaaaacacgtataacagaattactaaatataaaatatccaatttttcaagggggtatggcgtgggtcgctgatggagatcttgcaggagcagtttctaaggcaggtggtctaggtattattggtggaggaaatgcccctaaagaggttgtcaaagcaaatattgataaaataaaatctatgactgataaaccctttggtgtgaatattatgcttttatcaccttttgtagatgatattgttgatttggttattgaagaaggtgtaaaagttgtaacgacgggtgcaggtaatcctggtaagtacatggagcgctttcatgaagcaggtataacagtaatccctgttgttcctagtgttgcattagcaaaacgtatggagaaattaggggctgatgctatcattacagaaggaatggaagcgggtggtcacatcggaaaactgaccacgatgacattagtacgacaggttgttgatgctgttacaattccagtcattgccgcaggtggtatagcagatgggcgtggggctgctgcgggtttcatgttaggagctgatgctgttcaggtaggaactcgttttgttgttgctaaagaatctaatgctcaccctaattacaaagcaaaaatcttaaaagcaaaagatatcgacactgctgtttctgctcaggtagtaggtcatccagttcgtgccttaaaaaataaactagtaacaacctatagccaagcagaaaaagattatttagctggccgtatttcaatcaatgagattgaagaattaggagcgggagctcttcgcaatgcagttgttgatggggatgttattaatggttcagttatggcaggacaaattgcaggattaattaaatcagaagagacttgtcaagagattcttgaagatatttattcaggagcgcgtcaagttattctttctgaggcaagccgctggtcagatttataaatacaaataaggagacactatgaataaagtttcatttctatttgctggtcaaggtgctcaaaagttaggaatggctagagatttatatgaaactttcccgattgttaaagaaacttttgataaggcaagtcatgttttaggatatgatttgagagaattgattgataaagacttagacaaattaaatcagacgaaatatacgcaaccagctattctaacgacttcgactgctatttatcgtttaattcttaaagaaattgaacttagaccagatatggttgcaggactttctttgggagaatacagtgctttagttgcttcaggtgctataagatttgaagatgctgtagtacttgttgctagacgaggccaactaatggaagcagcagcacctgctggtagtggcaaaatggtagcagttttaaatgctgatcgtcaaataattgaagatgcttgtaagaaggcttctcagtttggtattgttagtcctgcaaattataatactccaaagcaaattgttatagggggagagtcaatcgctgtaaatgcagctgtagaagaattaaaacaacaaggagtaaaacgtttaattcctctgaatgtttcaggtccttttcacactgctttattgaaacctgcaagtcagaaattgagcgatgttttagataaagttcatttttcagtttctgaaatccctgtaattggaaatacagaggcgcagataatgaaaaaagacgatatcaaatctttattggcacgccaagttatggaacctgtacgctttgatgagtctattgaaaccatgaaaaaaatgggaatgacacaggttgttgaaattggtccagggaaggtactctcaggtttcttgaaaaaaatagatagctcattatcagtacattctgttgaagataaaattggatttaataatcttaaggaattaaactaggggaaaatatgcaattaaaagataagaacatttttattacgggttcaagtagaggaatcggccttgcaattgcccatcaatttgcacaattaggtgctaatattgttttaaatggacgttctgaaatatcagaagacttaatagctgaatttgctgattatggtgtaaaagttattgctatttcaggagatgtttcttcttttgaagatgctaatcgcatgattaaagaagctattgcaagtctaggtagcgtggatgtgctcgttaacaacgctggtattactaatgataaattgatgcttaaaatgactgttgaagattttgagagcgttcttaaaattaatttaacaggtgcatttaatatgacacaatcagtcttgaaaccgatgacaaaagcgcgtcaaggtgctattattaatatctctagcgtcgttggattaactggaaatgtagggcaagctaattacgcagcctctaaagcaggtttaattggctttacaaaatcagttgccagagaagtagcagcacgaggcattcgtgtcaatgccattgctccaggctttatcgaatctgatatgacagatgttatcccagaaaaaatgcaagaagctattttagctcaaattccaatgaaacgtattggaaaaggtaaagaagtagcgcaggtagcgtctttcttagcagaacaagaataccttacaggacaagttattgccattgatggcggtatgacgatgcaatgataaagaggaaataatatgacattacagcgagtagtagtaacaggttacggtgtaacctcacctattggaaacacaccagaagaattttggaatagtcttaaagaaggaaatgttggtattggacctatcactaaatttgattcaagtgatttcatggtcaaaaatgctgctgaaattcatgattttccatttgataaatattttgtcaaaaaagatctgaacagatttgatatgtattccctttatgccttatatgcttcaagtgaagctattcaacatgctaatttaaatttagatgaaattgatgcagatcgatttggtgtcatcgttgcatcaggtattggagggattcaagagattgaagaacaagtgattcgtcttcatgaaaaagggccaaaacgcgtaaaaccaatgacgcttccaaaagctctaccaaatatggcagctggaaatgttgcgatgaggttaggcgctcatggtgtatgtaaatcaattaatacagcttgtgcttcttctaatgatgctattggagatgctttccgtaatataaaatttggtattcaagatattatggtagtcggtggtgcagaagctgctattacaaaatttgccattgctggattccaaagtcttacagcattatcaacaactgaagatccatcaagagcatctattccatttgataaagatcgcaatggatttatcatgggagaaggttctggaatgttggtcttagaaagtttagaacacgctgaaaaacgaggagctactattcttgcagaagttgttggttatggtaacacttgtgacgcatatcatatgacttcaccacatccagaaggtttaggagccactaaagctattcaacttgcactggttgaagctaatattaaacctgaagaagttaactatgtaaatgctcatggaacttcaacacctgctaacgaaaaaggagagagtcaagctattgttgctgcacttgggacagacgttccagtttcttcgactaaatcttttactggtcatcttttgggtgccgcgggagctgttgaggcaattgcaactattgaagcgatacgtcatagttatgttccaatgactgctggaacgacagaattatcagaagatattacagcgaatgttatttttggtcaagggcaagacgctgatattcgttatgccatttcaaatacatttggttttggaggacacaatgcagttctggccttcaaacgctgggaggattaaattggatattcaagagattaaggatttaatgactcaatttgatgagtcaagtctgagagaattttcattcaaaacaagtgacggtgagctgtcttttagtaaaaatgagggaaaagctccacttgtcccaactatgtctcctatgagtcatcaacctgaagcgactccaactatagcaactcctgtctctaatgaagcaggtgagcaaacgaaacaagctactgaagtagtttcagaaatcccagagtcgactgtgactgttgcagaaggtgacgttgtcgaaagtcctttagttggggttgcttatttagcttctggaccagataaacctaactttgtttcagtaggtgatagcgtgaagaagggacaaactttgatgattattgaggcaatgaaggtgatgaatgaagtgcctgccccccatgatggtgtagttactgaaattcttgtagccaatgaagaagttattgaatttggtaaaggattggtacgaatcaaatgattgatataaaagaaattcgtgaggctttacctcaccgctatccaatgttattagtggatcgtgttttagaggtatcagaagatgagatagtcgctatcaaaaatgttagtatcaatgagccttttttcaatggtcattttccagaatatcctgtaatgccaggcgttttaattatggaagctttggctcaaactgcaggtgttttagaattatctaaagaagaaaacaaaggaaagcttgttttttatgcaggtatggataaagtgaaatttaaaaagcaagttgttccaggagatcaattagttatgactgctaagtttgtcaaacgtagaggaactatagccgttgttgaagcaatagcagaagttgatgggaaattagctgccagtggaacgttaacatttgcaataggcaattgaagatagtattgaatttagagggagagaagcatcaaaaatgtttaagaaaatattgattgctaatcgcggagaaattgcagtacgtatcattcgtgcagcccgtgaaatgggaatttcgacagttgctatctattcggaggctgacaaggaatcattgcacacaattttagcagatgaagctatttgtgttggaccagccaaatcagcagaatcttatttaaacgttaatgctatattatctgctgctattgtgactggagcggaagctgttcatccaggttttgggtttttgagtgaaaattctaaatttgctactatgtgtgaagagatgaacttaaaattcattggtccatctggagaagttatggataaaatgggtgataaaatcaatgctcgtacagagatgataaaagctgatgttccggttatcccaggatcagatggtcaagttacaagtgtagaagaagctgtatcaattgctgaggaaatcggctatccattgatgttaaaagcctcagccggtggcggtggaaaaggaattaggaaggtcaaatcagcagatgaattgaagcctgcttttgagtctgcttcacaggaggctttggctgcgttcggtaatggtgctatgtatattgaaaaagttatatacccagctagacatattgaagtacaaatacttggagatagctttggtaagatagttcacctaggagaacgtgattgttctctgcagcgtaacaatcagaaggtattggaagaaagtccgtctgtggcaataggtaacactctgcgtcaacaaattggtgaagcagctgttcgtgcagctgaggctgtatcttatgaaaatgcaggaacaattgagtttttgttagatgagaatagcggacagttctatttcatggaaatgaatactcgtgttcaagtagaacaccctgttacagaatttgtaacgggtgttgacatcgttaaagagcagattcgtatcgctgctggaattcctttatcagtttctcaaaatgatattaagttaactggtcatgcgattgaatgtcgtattaacgcagagaatccacaatttaattttgcgccatgtccaggtaccattaatgggttacatctacctgctggcggtatgggcttacgtgtcgattcagcggtttacacaggctacactattcctccttattacgatagtatgattgcgaaagtaattgttcacggagaaaatcgttttgatgcacttatgaaaatgcaacgtgccttatatgagcttgaaattgatggtattgtaacaaatacagaatttcaaatggatctcatttctgataaaaaagtcttggctggggattatgatacttcattcctgatggaagactttttaccaaggtattatggtaacaatcaataggagggaagatggctttatttagtaaaaaggataaatatatccgtattagtccaaacaaagcattagggtcttctgataaacgtagtcttcctgaggttcctgatgaactctttgctaagtgtccttcttgtaaacatatgatttatcagaaagatttaggattagcaaagatttgtccagcttgttcttacaactttagaatttcagcgcaagaacgtctgttgctaacagttgacgaagatagttttgaggaattatttacaggaattgaaactaaggatcctttgaattttccaaactaccgtgaaaaactggctgctacacgtcaaaagactaacttagatgaagcggtggtgacaggtttagctaaaataaaaggacaaactacggccttagctattatggattctcattttataatggcgtctatgggaacggtcgtaggcgaaaagttgacaagattatttgagctagcaactgaaaagaaattacctattgttatttttacagcgtcagggggcgccagaatgcaagaaggtattatgagtttgatgcaaatggcaaaagtatcggcagcagttaaacgccattctaaccagggattgttttatttaacaattttaacagacccaacaaccggcggcgttactgcgagttttgctatggaaggtgatattattctggctgagccacaagcgttggttggttttgctggtcgtcgtgttatcgaaacaacagtgagagaagatttacctgaaggctttcaaaaggcagagtttttgttagaacatggttttgtcgatgctattataaatcgaacagaattacgcgactgcattgctcaactaattgctttccatggaaatgaggttggtcatgaataatgatgtgacaagaattttaaaagatgcgcgtgatcaagggaggctaactgctcttgactacgctgaattgatttttgataattttatggaacttcatggtgatcgccagttcgcagatgacaaatcaattataggaggtttggggtacttggcagggcgtcctgtgacgattgtcggtattcaaaaaggtaagaaccttcaagataatttagaccgtcattttggtcaaccacatcctgaaggttatcgtaaggctttacgtttaatgaaacaagctgagaagtttggaagacctgttataaccttcatcaatactgctggagcatatcctggggtaggtgctgaggagcgaggtcagggtgaagcaattgctagaaacctcttagaaatgagtgatttaaaagtccctattatagctattattattggtgaagggggttctggaggagcattagctttagctgttgccgataaggtttggatgttggaacatactgtttattctattttaagtcctgagggctttgcctctattttatggaaagatggtacaagaacaacagaagcagcacaattaatgaagatgactgctggagaactttaccatatggaagttgtagacaaagtaatccctgaacatggttatttttcaagtgagattgtcgatatgattaagacaagtttaatttcagagttagaagtgctctcacaattatctcttgaggatttattggaacaacgttaccaacgttttagaaaatattaatagaaaaaggctgagttatttactcagcctatatttagtttttcaaggtattatcatagttatagtttcatattttgttataattgataaaaaggagatatatcaatgacactagcattagccaatttttagattgtagtctaatccaaaattttcagaaagagtcatttcgaacactttattctaagtaccattatttaggctctccttaacttgagactctatctgttattgaagagaaattttctagaaaaaatagctattattagattttagaaggctatgaaaagattggtttttaaagagttccattaagtgatgaagaaagtaaagcttggttagttataattgcgattagaccttgtttctagcaacgaggcttcgctagaaatactttaaaagaacttgaaagtatgtatagatatatataatcgtgaaaacttaactattgtttacatggagaaaaagaatgtatcaagaattaaatgattatttagaattccaatcaatgaagtatattatgcctgagaaggcaggcgctttaaaggacgatatgcaaacttttaaggcaaagggccaacttgctaggaatagctttacagagttatcaagagccttagaacaacgtatggatggctttaaaatgcaaagagtgagtaattgggctaatcaagctcaagtagggcgtccacatttttgggtttattatcgaaaggatacagaccaattagatgatgtggctgttgcgctaagggtttatggtgtaaaagatagttttggggttagccttgaggtaagctttgtagagaggcaaaaatctgataagacactcgagaagcaggctagagtgttatcgattccgattgcctctccattgtattttatggtccaaaggcaaggtgaaactcatcgagaagaaggcaatgaggaaaatcgtcaacgtttaatgcaagaaattaagtcagggaaggtaaggaaagtattggtaaaatatgacgttcttttgactgaaaaccagagcttagaaaatattctgcaacgattgttagaaggctttgagaaagtgttaccttactatcaagtttgtcaaactattagctaagttcatagaaaaaatgagttggtataccaactcattttagagtgcctaatttggtttaataatatcgatattacccatatatggacgaagaacttctgggatagtcacagaaccatcttcattttgataattttcgaggattgctgctacagtacgtccaactgcaagtcctgaaccatttaaagtatgaagcaacctaactttgccatcaacttcgtcacggtaacgaatttgagcacgacgtgcttggaaatcttcagtattagaacatgaagaaatttctcgataagtattttgagcgggaatccatacctctaagtcatacgttttagctgctgagaatcccatatctcctgtacacaaggtaatgacacggtatgggagattaagtttttgaagaatattttcagcatttgctgtcattttttctaattcttggtatgattcctcaggcttggcaaatttcaccatttctactttatggaattgatgaaggcgaattaatccacgtgtgtcacgtcctgcagagcctgcttctgaacggaatgatggactcatggcagtaaagtatataggtaattctttcccatcgataatttcatcacgataatagtttgttaaaggaacttcagctgttgggataagtacgaatgggctatctgctaattcgaaagtatcttccttgaactttggatattgtcccgtaccgaacattgaatcgtggttaaccatataaggagggatcacttcagtgtacccctccttagcgtgttcatccagcatgaagctgtagatagcacgctctaaacgagcacctagacctttgtagaagaggaagcgagagccagtaacttttgcaccacgttcccaatcgagaattccaaggctttcacctaaatcccagtgagctttggtctcaaaatcaaattcacgaggagttccccagcgacgaacttcaacattttcatcctcgtctgctccaagcggcacatcatcagctggtgtattaggaagtacggtcaccattgattgtaaattagcatccacatctgccaattccgcatcaattgctttgatatcagcggaaagtgtttgcatagctgcgatttgctcgtctgcattctctttatttcgttttgcttgagcaatggcagcagaagcaacattacgttgcgctttcgcctcttcagctttgataagtagttcacggcgttttatatcaagttctttaagggttgttaatgtttcttggtcaacaccacgcgtggccaattttttagcgacaacatcaaaatctgtacgaatacgttttaagtctaacatataggaatctcctttatactaaaaaacaccctgtcatgctggagcgcaaaggcgcggttccatccagcttcacagaagtgcacttgattgattgattaaattatttcccataaatggaacacggtagaatttcataaaacaatcttatctgctcgcaacgaccgcagactctctgaaaagaactattatactacttatccgttaaggttattatatccaaaaataagtaaaatgtaaaccttaactttataagcctgctctttgttttagtgaaatagctatgctaaaatatgattatggaaaagtatacaagtattaaacaatcaggtcgtcattacggcttagaccttttaaggattatttccatgttcatgattgttattacgcatgttcttggaaaaggtggtctgagatcttcggttgagggacacgcagactcctattttatagtaacgtggattatccaagtcttagtttatggggccgttaactgttacgcactaataagtggttatgtgggaattaattcgcgttatcgttactcaaaattactgtctatctgggcacaggtttttttctacacctttacaataacagcactttttgcaatcacaggtcatgaagtgaccttgcttaattggagagatgcttttttccctattgtcagtgggcagtattggtacattactgcttactttggtctattggtttttatgcctgttattaataatggattaaatgccttgactgataaacaattaaaacaattggttttgttaatgtttattattttttcaattttaccagctgttttaaataatcgtgttccagaattttcattgagcaagggttttgaaatgacttggctactgattttatatattattggtgcctatttgaaacgtattgatttaaatatatttaaaacgtcatatttacttataatttatctattatcattggttgctacttatgccatgaagtttagcgttggtgatatttggtattggtatgtttcgcctactttaactttaggggcggtaagtttgtttatattatttgctagagcaagcattaagccctcgggattcttaaagaaaataattgttgtattagccccttcaaccttgggagtttatctctgtcatctccacccactaatagtaaaatattttgtaagagattttgcagagacgtttgtttatgagtccatttatctttacccatttttaattttaggagcagggattttaatttatttgttggcttttattgtagaacgtattagattacgaatatttaaagcaatccatttttctaactttttgagatggtttgatgacaagttcccatattaatattagagttaaaaaataagatagactatagtctatcttattttttaaacttgaatatttttaaaatggtctggatgagggtaggaagcttaacaactttatcgtctccaatatgtcgtctcgcatgctttaatatcgttccagagtctttagaggcgaataaaaattttccttggtctgtaaagacctcaaagtgacgactaattttttttcgactaacattagctccaatttgattgattgatgtccatggaatttgaatatagtcgttgacatttttatcgttatagaattctaatgcctggtcaccaactaaaaattttccaactttattccccatacctaaatacgaaactcctgttgtttgaaattcaacagttttgtttaatgattgtgccatgactaatccctttttaatttatagtagtttgattatatcataatagtgggactctaagtggattttatgtaataaaatataagagatggaatactattgtaaccatctcttagttttattacatcacacctgcaaggcgagctagaataccaacgataaacaaaccgatgataattgtaattggtgatactttcttcttaagtaaccacatacagaagaatgtaagaagtaatccagctaaaccaggaataagtgagtcaagttgtccttgaagtgtttgtggttgcattttatcaaggcttaagccactctgaacttgtcctaggatatcatgcaattgttgtccactaacatggtctttagggaaattgatgtatgccccttctgacaatgtctttttaggaaggtctacagtaaagttaattgctacccaacgcttaacaaggacagcaaggatgaacataccaaggattgaagcacctttagtaatatcttggaggataccaccagacatatctttagtaatttctttacctgatttgtaacctaactcttgtgtgtaccataagaatgacatacgaatgaggttccaaccaacaaagaagatgattggtccgaggatattaccagcagaggcaagtgaagcaccaagagcacctaagataggacgtacagtaaaccagaatactggatcaccaataccagcaagaggtcccatcataccgattttaaccccttgaattgctttgtcttcgacaggtgtaccgcttgctttttcttcctcaagagcaagggttacaccgataattggagcagcaacgtatggatgtgtgttaaagaattccatatggcgctcaagcgcagcagcacgatcttctttagtagtgtaaagttttttcaatgctgggataagagcataggcccaccccatattttgcatacgctcatagttccaagaaccttgaaggaattgtgaacgccaccaaactttttgacgatctgattttgataatttaatttgttcagtcattgtttagctcctttctagtagtcctctaagatatcgccgataggatcgttagaacctgcgttagaagtacctttgcttccacccatttttgataaactgatgtagatgagggcgatagcaacaccaatagtacccattgcaataagagttaactggttcaaagctgctagagcaaatccaagagcaaagaaaggccaaacttcgcgagtagccatcatattgataaccatagcgtaaccaacggcaacaaccatggcaccaccaacttgcataccaccatttaaccaatcaggcattgcttcaagaatactttgtactgaagaagatggaatagctaaaagaagcgcagctgggaatgcaatacgtaatccttggagaaggagggcgataaagtgaaaacgttcaattgctgcgaagtttccttcagaagcagctttgtcaccagcgtgaacaagtgcagttgagattgtacgaacaatcattgtaaggaaaagtccagcaatagctagaggtacagcagtagagaaggcaaagttgatacctttttgagtgaagtcaccacttttaaccaaaataatagcagcagcaacagaggcaagtgcagcgtctggtgctacggcagctccgatatttgcccaagcaagagcaatcatttggagactaccaccaagaataatacccgcttcgaggtgaccagttacaagaccgattaaagtacaagcaacaagaggttgatggatttggaattggtcgaggataccttcaagaccagcaaagaaggcaacgataacgaccaaaatcattgagataattgaaatatccgccattttgatatcctttcgttttcagagataataagttattttacgtttgctttgttgattaaatcaaacaaattctttttagcgtcatttggtactttacgtacatcaaatgatacacctaagtcacgtaatttttcaaaggcagcaacatcgtctttatccattgaaagaacgttgtttaccattgttttaccagttgagtgagccattgaaccaacgttcaattcagggatttccacaccaccttcaattgcacggagtgcatcttgtacagtttcaaataagatcaaggcacgtgtgtttccgaaacgtgggtctttagctacttcaattaatttactaattgggacaacgtttgctttgactcctccaggagcagcttgcttaatcaattgtttacgaagttcatctttagaaacttcatcagaagcaacgataatacggtttgcttttgatgctggagtccatgcagttgcaacttgaccatgtaaaagacgtgtgtcaatacgagcaagattaattttaagcttgccatctccaataacagttccttcagggatagatccactttgtttaacttccgcaggaacatctgcaggaacacctgctacaggagtagcttctacaacaggattaagttcttctggaagggctttgataccttccttagactctttaataatatttgcggcaacttgttcaacacctgcattagcgtccatcatacgctcagtataggcttggataagcattggcaaattgagaccagtgatgatagccattttacgttcaggattttctcccataacacggcttgcttggttaaatggtgacccactccaaaggtcagctaacacaagcacctcatcatcagcatcaaattgtgcgatagcattgttgaagtgtccatacaaatcatctggtccttcatttggcatgaaagttacaacttgaactttttcttgttcaccaaagatcattgaacctgattgatgaataccttcagcaaatttaccatggctggcaataataataccgatacccattcttgttcttcctccttaaaaaattttttcgttgacataaagaagaataatctccttccaatcgtaaaattggccattctttttcatttcaacgaaattatagaacagatatattttaaaacgttttcagaaaaaaatcaatactatttctaataaaaattaaaaaaaaagatatttttttcacaaataccttttataataggggaagagagtggtaactttttttgttaataatatagtagaaaacctaaaaaacgatttctattagaattctgtttcaatagagatcatttttgaaaatactacaataataatttttctagagttttagcaacaccatcttcttcgtttgtccattggatttgttggtcggcatatggaagtagagttggattagcatttttcatagcatatcctgtatgtgcaaaggccagcatctcggtgtcattgtgttcatctccaaaggcaatcaaattttcttgtgaaagattgagtgattttaataaatgtttgagagcataagctttgttaacacctttaggtgaaaattcgagtatattcaatggaccaccccaagaatctacttctagttcgtgattaaaatgttgtcgtaactctttagctaactcatacttatctttatgacgtgtttgcatcaatagagcatttggattgcgtgtgattttagtaacatctaatgccattttatcagtaatttcattgacaccgaataattgtgggttaattttatcacgattatccatagtaatgtaaaaatttttacggtattcgctagcaataaaatcggcttggatagcatctgataaatttaaggtttcaaggagtaattttttatcaatcgttgcactacgctcaaacgcccactttttttcggggatatgagttaaagcaccattaaaatttatcattggtgtttttaaatctaggcgtaaataatgagcgagtgccatacggtatgggcgtccggttgtaataattactttgtgtccttgagcttgaacttttcgaagtgtatcagcggtgtagtcagaaatagtgttattattatgtaatagagtaccgtctaaatctacggcgataattttctttgtcatgctgacattatatcaaaaatagatttcaataaaaagagacagtagaaatatgatataataactgtggaaatatggaagttggtggattatgaaaaagttaatttggagtcatctttttgccatagtcagtattttagggatatggtattatcatgtaaaaattgatcatttgatggtaattctattggcatcagtcttgtcgttagagatgggattcattgcttattatagtcgtaatatttttattcgtcttttagcaagtttaggtcttttatttttttacccacagagtttagggatttttcttagtttggtgagcttagagtggtcaacaaaagacatttggcagtctaatcactttatgcaatatatggcataccttcttgcaattctttttattatctcttcagctttactaagcttgaagctattggtaaatgcatatgatattagtaaaaggtatcaattagcaactgttatacctgtaatgctttttagtagttttgccttttgcttagaaaaatcaggatcattaggtttagaaggaatcattttaaatccgtcagcattttttaatggaatacagactaatatggctaaccttgattttaaagccttgtcttgcctttttttagtacaattattactttggggaatattaatggaagactaaccacaacagggttagtcttttaggtttgaagtttatttaaccttaatttaataatatgttgtataatgagatattaattggaggttagaatgaaagtaaaactatttgcgatacatctattttttattgttatttcttttgggattaaatattatcatttgcagggaccaaatttgatttggaatatgactctagccctaatagcgttagattttgcataccttactagtttatttaagaaaaaaattcttatcggtctttttgcacttgcttggttttttttctatcctaataccttttatatgttgacggatatcattcatatgcattttgtcggagacgttctttataataagacaaatttaatactttatatcttgtatgtatctagtatcttgtttggttttttatcaggtatcgaaagtttttctgtgattatgcgtaaatttagaattagcaatatatttttaagatggggaattattggaattgtatcattagtttcaagttttggtattcatattggtcgttatgcccgtctaaattcatgggatatcttaacgaagccacaagtggtaattaacgaacttttagcggttccgagtagggattcattccactttattttaggatttacatttttacaggtattgtgtcttatttttatggattattctgcagggaaaaagcttgaaaagtgaattattttttgttaatatatattagtcgttcgtaaatataagaacgattattttttttaaaagtgtaaaatagcaaaaaataaaggagaatccgattttaaaatggaaaagttttttaagctaaaggaacacgggacgacaattcggactgaaatcactgctggtctaacgactttctttgcaatgtcgtacattttgtttgtaaatccagctattttatctcagactgggatgccagcacaaggagttttcttagcgacgattattggtgccgttgtagctacatctgttatggctttctatgctaaccttccctatgcacaagctcctgggatgggattaaatgctttctttacatatacagttgtctttgcattgggatatacatggcaagaagccttagctatggtatttatttgtggtttgatttctctgattattactttaacgaaagttagaaagatgattattgagtctatcccaacaactttaaaatcagccattacagcaggaatcggaacttttttagcatacgttgggattaaaaatgctggttttttgaaattttcaattgatcctgggacgtatgatgttgttggaaagggtgctgcgaaaggattggctactattacagcaaattcttcagcaacgccagggctagtgtcgtttgataatccagccattttattatctttgattggtttaagcattaccatcttctttattgtaaagggtatccgtggagggattattctatcgatattaacaacgaccctcttaggtattttaatgggagtggttaagttagatgctattaattgggaagcaactaacctctcggcctcttttagagatttgaagcaagtatttggagttgcattaggagagaaaggattaatttctttattttctaatccttcacgtctaccaagtgtattaatggccattcttgctttttcactgactgatatttttgataccattggaacgctcattggtaccggagaaaaagttggtatcttagcaacgactggtgataatcatgaatctaagagtttagacaaagcactctattcagacttaattgggacaacttttggtgctatttgtggaacatctaacgttacaacctatgttgagtcagcagcaggaatcggagctggtggtcgtacaggattgacagccttagtagttgctggtttgtttgctatatctagtttttttagtccactagtatctatcgttccgagtcaagctactgcaccaatattggttattgttggtattatgatgctttcaaatttaaaagatatcaaatgggatgatatgtcagaagctatcccagctttctttacttctctttttatggggtttacttatagcattacttatggtattgcagctggtttcttgacctatacactagctaaagtcatcaaaggacaagcaaaagatattcatgtggtactgtggattttagatatattatttattctaaactttatcagcttggctattttgtaatattatagtttgataaataagataaaaggaaatcagatttgtagcctggtttccttttttcttaagaaaagtgaagaaatatatgctatggggctgtcagaatcagcaaactgttggaagacagagatatttctggtataatatctctatgttttatactcaaaatgaagaagagcttattgccctagggcaaaaactgggtactgttttaaagtcaggagatatcgtattattgactggtaatttaggtgcaggcaaaacaactcttacaaaaggtattgcaaagggattagacataaaacaaatgattaagagcccaacttacactattgttagagaatatgaagggcgtgtaccactttaccatttggatgtttatcgtattggagatgatcctgattctattgacttagatgacttcttgtttggtcaaggagtaacagttattgaatggggagagttgcttagtgataaccttatcaataactacttagaaattgttattacgaggagcaatcaaggacgtcaggttcagttagaagcttatgggcatcgcgcaagagaaattattgaggcgattcaagatgtctaaacaatttgctgttgattttatagaagcttcgagagaggaagcatctgcgatccttgaatttttaaatactgttactgaggaaacagattttattttgcatacggtgagcaatcaactatctttgtcagaaatggaaacgtttattgaaaataccttaatgacgaaaaattgcatttgtttgattgctaaattaaaaaataaagtgatcggcttgataacaatcattagtcagtctgatattgaaattgaacacgttggggatctttttattgccgttcagaaggattattggggatatggtattggtcatattctcatggaagaagcaatagaatgggcgtcagataacgatattacacgccgcttagaactatcagtccaaggacgtaatgaacgtgctattcacctctaccaaaaattcggttttgaaatagatgggcttcaaacaagaggtattaaaagagaaaatggagaatttctagacatttacagaatgagtaagttgatagattaggaatatacatgaaaatttggaaaaaaataaccttaatgttttctgcaattattttaacaacagtaattgcattgggagtctatgttgcctcagcttataatttttcgactaatgaattgtctaagacttttaaagattttaagctagctaaatcaaaaagtcatgctattgaagaaacaaagccgttttcaatactattaatgggggtggacacaggttcagagcatcgaaaatctaagtggtcaggaaatagcgattctatgatcttagtcactataaatcctaaaactaataaaacaacgatgacaagcttagaacgtgacgtattgattaaattgagtggtcccaaaaataatggacagactggagtagaagcaaagctaaatgcagcctatgcttctggtggtgcggaaatggcattgatgactgttcaagacttattagatattaatgttgattactttatgcaaattaatatgcaaggattagttgatttagtcaatgctgttggtggtataacagtaactaataaatttgactttccaatatcaattgctgccaatgaaccagagtacaaggctgttgttgaaccagggacacataaaataaatggagaacaagcacttgtttattctcgtatgcgctatgatgatccagagggagattatgggcgtcaaaaaagacaacgtgaagtaattcaaaaagtccttaaaaaaatattggcgttaaatagtattagttcatacaaaaaaattctttccgcagtaagtaataacatgcaaactaatattgagatatcatcaaaaacgattcctaatttgttagcttataaagattcattggaacatattaaatcttatcagttgaagggtgaagacgctactttatcagatggtggctcttatcaaattttaactaagaaacatctacttgcagttcaaaatagaattaagaaagaactggataaaaagcgtagtaaaactctgaagacaagcgcgattctatatgaagattactatggtactactgctagtaatgattcttctacttattcatcaacacaagagaataattataatacaacaccttattcagaagcaccaccaagttacagtggtaatactacttatagttctgagactaatcaaacaactcatcaaaattactataatagtagcactcctgctagtaactatagcagtaacactaacacaggtcaggctgattcaagtggaagtgtcaataatcataacggggctgcaacgcctaatccaaacacaggaacgcaaccagtaccaggtcaaactaatccataaaatataaaaaagagcattatttgctctttttatatttagagtagatatttttataccgtcggcttattcgtctttctcttgatatttagccatgcgttgattaatttcttctaaacgaggttgaatatctttattaaacacttggaatttatgattgagttcttgagaaattaatctgattttttctttttcctgactaataatagcaagatcatttttgatacgttctaattttaatttagctgaatctgtctcattttttgtattttgataggaatccttgatagtttttctatttttgtaaagttcaagcgctcctaaactaactaaacctagtgcaattaaacgacctattttcataattgaatctcttttctaatttctttggctaattttgcaagtgcctcaaagtcgggttcatgagtagtgtagtgaattttgataccgtctgattcatcaaagcggggaacaaggtggacgtgtgcatgaaaaacagtttgtccagcaatttcctcattgttgttaataatattcattcctttggcttttgtagcagcttggacagcacgcgccactttaggcaagcgttcaaaggttatctgtgcagttttttcatccatctctaacacatttcgaacatgttttttaggaataagaagggtgtgcccggtcgtagtttgtgtaatgtcgagaaaagctaatacttcatcatcttcataaacttttgatgaagggatttctccactgatgattttacaaaaaatacaattatccataactaattcctttcatgttgaaaaatttattgggtagctattaaggaatggtaaatttttatcgtttgataggtcataagtcgtacagggaaatgaaagtagcccgtattgattgtgatatctatatttaccatcatacttatcttagcatgacctaaagggtattgcaatttttaatgatgtttattattgagtaagtacatttctagaattttggaagtatctaaaataaatttaaatataatgattgacatttttatctaattaaatgtataataaataatataaataaaataaaaatgataattgagatttatcatagaaggaaaactattttgaaattaaataaaataatattatctactgcagctcttactgctctctttttaggatataatagcgttactgcggatacatataataactatcagccacatagatcaaataatatggatttaactgaggaatataactataataaccagatagaacttcaggagcgtataaaaaaactaaatataccttttaaagaaaaacttgccttacttagaaaggttaaatcaagacaagattcttatgtattagacacattaagaaaagaagttgaaaataaaaacagtgagtattcagaactagagcaagaatatcaaagaatttcagctcttattgatgctaagtttccgcaagggaaatctagtttagcagaaaaattacataaagaactaatttgggacttggatggtgttaaatatgatgagggtatttctaagagaactgctctaaaaaaattagaaggtaaaatcaacgaatatactaaaaaatacagttatttattctgataattgagtttgatagttttatagcctaatattctgattactttgcatttattatattgatactaaaaagacacctttttgaggtgtctttttttgtccgatgagtgatggaggtgctttttgtaaacataatgggagcatggggtagcttggcatttcattagatgtaaaagcggacaaaataggtttaaagttattttcaaaactataagggaattctaaagtacaattatccataagaatagaccttccctttcttattttgttataatagttaataaagtatatcaaagatagagagaatgacaatgttaaaaattgaaaatgttacaggggggtatgttaatatcccagttttaaaaaatatttcttttgaagtaaatgatggagagttagttggattaattgggcttaatggtgcaggaaaatcaaccactattaacgagattattggtattttgagaccctatcaaggagatattacaattgatggtattagtcttgaagccgaccaagaactttatagaaagaaaataggctttattcctgagacaccaagtctctatgaggagctaactctcagggaacatttagaaacggtagctatggcgtatgatattgccaccgatgaagttatggcacgtgcgcaaaaactattagagatgtttcgtctaacagataaattagactggtttccaatgcatttttcaaagggaatgaaacaaaaggttatgattatttgtgcttttgttgtatctccaagtttatttattgttgatgaaccatttttaggtttggatccactagctatttcagatttgattaatcttctagcagaagaaaaagctaaagggaaatctattttgatgtcaacacacgtattagattctgccgaaaaaatgtgtgatcgttttgttattttacataaaggagaaatacgggcagttggaaccctagaggaattacgggctatttttggagacagtaatgctaatttaaatgacatctacatagctctgacaaaagaggtgtgatatgaaaaagttatttaataaacgtcgaagtctctttttaactcaaaatagtaaatatttgagatacgtctttaacgatcattttgtattagtattaatgtttttgtcaggttttttgttatatcagtatagccagttactaaaagactttccaaaaacacattggccaattatcgtgattgtgtcaatcattatcttaatgttactagcgatggggggaatagccagctatttagaaccggctgataaacaatttttacttataaaagaagaagcaataaaggaaattataaattctgctaaaaaacggacttatatcttttggttggttattcaaaccttatttttagtattaatatcaccaattttgataaagttaggcttgtcagtttttatgattacattgttaatttttggtctaggaataatcaaatggttggtaataacttacaaggtaaaggtcttttataacaatcaaaatttgaactgggatgcagctataaatcatgagcaggaaagaaaacagagtatattaaaatttttctctttgtttacaaatgttaaaggaatttcgacaagtgtaaaacgtcgttcatttttagatggtattttaaaacttatttctaaaacgccatcgcgtttatggactaacttatttgtgagggcatttctaagaagctcagattatcttggtttaacaataaggttggtaactttaaatatcttatcagtcatctttgttaacgaaacctacctcgcccttgctctggcatttgtatttaactacttattattgttccaactattagctttaggtcaccattttgattatcaatacatgaatcagctctatccagttagattaaatgctaaagcaagtcagctaaaaggttttctcagagtattatcatatgctgtgacagtaattgatagcatacttataagagaattgaaacctgttatattattgatagttttgatgttaattgtgacggaatattacatcccttacaaaataaagaagatgattgactaaagcctataaaacaagtaaaataagaggaaacgactaaatgaaaaggagggactgctggtgacaatatcaaatcaagaattgacgcttactcccttaagaggaaaaagtggcaaagcctatattggtacttatccaaatggtgaacgtgtctttgtcaaatataatacgacacctattttgccagccttagctaaggaacagattgcgccacaactactgtgggcacgccgtacaagtaatggcgatatgatgagtgctcaagaatggttagatggtcgaacattgactaaagaagatatgggtagtaaacagattattcatattttattgcgcctgcacaagtctcgtcccttagtaaatcagctgttacaattagggtataaaattgaaaacccttatgatttgttgatggattgggaaaaacaaactcctattcaaatccgggaaaacacttatttgcaatctattgtgactgagttaaagcgtagtttacctgagtttcgaacagaggttgcaacaatcgttcacggagatatcaaacatagcaactgggttattacaacaagtggtttaatttatttggttgattgggattctgttcgtttaacagatcgcatgtatgacgttgcatatattttaagtcattatattccacaaaaacactggaaagattggctgtcttactacggttataaagataatgagaaagtctggagcaaaattatctggtatgggcaattttcatatttatcacagataatcaaatgttttgataaacgagatatggagcatgtcaatcaagaaatttatgaattacgaaagtttagagagttaattaaaaagcataatgcgagttagaaaacgtaagggtgcagaggaacacttagaaaataatcctcactatgttatttcaaatccagaagaagccaaagggcgttggcatgagatttttggaaataataaccccattcacatagaagttggttccggaaaaggggcttttatcactggtatggcagagcaaaatccagatatcaattatattggaattgatattcaattgtcagtgctttcctatgctttggataaagttctagatagcggtgctaagaatatcaaattactattagttgatggttctagtctatcaaactactttgatactggcgaagttgatttgatgtatcttaactttagtgatccatggcctaagaaaaagcatgagaaacgtcgattgacctataagactttcttggatacctataaagacatacttcctgagcagggggaaattcattttaaaacagataatagaggtttatttgaatatagccttgctagcttttctcaatacggtatgactttaaaacaagtttggttagatttacatgcaagtgattaccagcaaaatatcatgactgagtacgaacgcaaattttcaaataaaggacaggttatctatcgtgtagaagcacgattttagaataagtaaatagtaagtgggtagttatttgctactcctttatggagaggtcgcatagtggctgagtgcgcacgcttggaaagcgtgtagtccctaatgggggctcgggggttcgaatcccctcctctcctttaatcttgttaatgtatcagtgtttattaagtgttcacctttttcactcgtcaaaagtccaagtttcgaaaaatttcttttattttatcatcgtttctctttgagcttgaagtattagcataaagttttctaagctcttacaaagaactgaggacaaaattttaattttttgatataagattagtgtacggtgatgctaatttaaagtaaatgattgcaataatcgtattttgtgctataatagtattaaataatacagaaaggggcggagttttacttcgcctcttatgtgtgtgattcatagaatttatagtcattataagttctaaagcaagttagaaagaagaggtagctgttatcgcaaatcaaactattgttgatattgttactcaagtcgtaactcctgctattcaagcaccgtttgaattagtagatgtagaatacgaaaaaatgggtggcgactatgtgctcagtattttaattgataaacccggaggcattacggttgaagatacagcacaattgacagacgttgtaagtcccttacttgacacaattcaaccagatccatttccagaacagtatatgcttgaagtctcaagtcctgggttggaaagaccacttaaaacagcagaagcattatcaaatgctgttgggtcttatatcaatgtaagtctgtataaatccattgataaagttaaaatatttgaaggtgacttattatcatttgatggtgaaaccttgacaattgattatatggacaaaacacgtcataaaactgtagatattccctatcagacggttgcaaaagcccgtcttgcggttaaactttaagaaaggatgattcttgcgaagcaagaatggacactatgagcaaagaaatgctagaagccttccgtattttggaagaagaaaaacacattaataaagaagatattattgatgcagttactgagtcactaaaatctgcctataagcgtcgttatggtcaatcagaatcatgcgttattgaatttaacgagaagaaagcagactttaccgtctatactgttcgtgaagttgttgatgaagtttttgatagccgtttggaaattagcctaaaagatgcccttgctattagctcagcgtatgaacttggtgataagattcgctttgaggaatctgttacagaatttggacgcgtggcagctcagtcagcaaaacaaactattatggaaaaaatgcgtcgtcaaatgcgtgaagtaaccttcaatgaatacaaacaacacgaaggtgaaattatgactggtactgttgaacgatttgaccaacgttttatttatgtcaatctcggttcacttgaggcgcaattatcgcatcaagatcagattcctggagagagctttaaatctcatgatatgattgatgtttatgtctataaagtggagaataatcctaaaggagtcaacgtttttgttagccgtagtcatccagagtttatcaaacgcattatggagcgagaaattccagaagtatttgatggaactgttgagattatgagcgtctctcgtgaggctggagatcgtactaaagttgctgtacgcagtcataattcaaacgttgatgcgattggaacaattgttggacgcggtggaagtaacattaaaaaagttatcagtaatttccatcctaaacgcgttgatgctaaaacaggattggagatcccggttgaagaaaacattgatgttattcaatgggttgaagatccagcggaattcatttacaatgctattgcaccagccgaagttgatatggtactttttgatgatgaagatacaaaacgtgctactgtagttgttccagatagcaagttatcgctagctattggtcgccgaggacaaaatgtgcgtttagcagctcatttgactggctatcgtattgatattaaatctgcaagtgaatacgaaaaaatggaagcgcaagaacttcaaactgaggaagtagctcaagaatctgaagttatttcagataaggcagaataatataaatgagagaggtgttttatggctaaaacaaaaaaaatacctttaagaaaatcagttgtttctggtgaagtgatcgataagcgagatcttttacgaattgttaaaaataaagaaggacaggtttttatagatcctaccggaaagcaaaatggtcgaggtgcctacataaaattggacaatgatgaagctatcctagcgaaaaagaaacgagtgtttgatcgcagtttttcgatggaagtttctgatgaattctatgatgaactattggcatatgtcgaccataaggtcaaaagaagagagttaggccttgaataattcagaaaaagtattaaatctcattgggttagcacagcgtgcggggcgccttattacaggtgaagaattggttattaaagcaattcaaaatcaacaagtatcgctaatctttctagcaaatgatgctggcccaaatttgacgaaaaaagtaactgataaaagtaattactacaaaacagaagtctccacagtgttttcaacactggaattaagtgatgcgttaggcaaaccaagaaaagtggttgctgtcgcagacgctggattttcaaagaaaatgaggactcttatggcataacagaataggaggacatcaattgtcaaagaaaagattacacgaaatcgctaaggaaattggaaaaacgagtaaggaagtggttgagcaagctcaatcgcttggcttacctgtaaaaagtcatgcttctagcgttgaagaaaatgatgctacacgtattgttgagagttttagctcttctaaaactaaagctccaacaaattctgttcaaactaatcaaggtgtgaaaacagaatctaaaactgttgaaaccaaacaaggcttgtccgatgataaaccttcaactcaacctgtagctaaaccgaaaccacaaagtcgtaactttaaggcggagcgcgaggctcgtgctaaagctgaagcggagaagcgtcaacataatggggatcaccgtaagaataatcgccataatgatacacgctctgacgacagacgccatcaaggtcaaaagcgttcaaatggtaatcgtaatgataaccgacaaggtcagcaaaataaccgtaataaaaatgatgggcgttatgctgatcataaacagaaaccccaaacgcgtcctcagcaacctgcaggcaatcgcattgactttaaagctcgagcagcagctttgaaagctgagcaaaatgctgaatactcacgtcatagtgagcagcgtttccgtgaagagcaagaagccaaacgtcaagcagctaaggagcaagaactagctaaagcagcagcgttaaaagcgcaagaagaagctcaaaaagctaaggaaaaacttgcttctaaacctgttgctaaggtaaaagaaattgtcaataaagtagccgctacgccatcacagacagcagatagtcgtcgtaaaaaacaaactcgttctgataagtctcgtcaattttcaaatgaaaatgaagatggacaaaagcaaacaagaaataagaaaaactggaataatcaaaaccaagtgagaaatcaaagaaatagtaactggaatcataataagaaaaataaaaaaggtaagactaatggagctccaaaaccagtaacagagcgtaaattccatgaattaccaaaagaatttgaatatactgagggcatgaccgttgcggaaattgcaaaacgtattaaacgcgaaccagcggaaattgttaaaaaactctttatgatgggagttatggcaacgcagaatcaatcattagatggagacactattgagctattgatggttgactacgggattgaagcacatgctaaggttgaagttgatgaagctgatattgaacgcttctttgcagatgaggattaccttaatcctgataacttaacggaacgtccgcctgttgttactatcatgggacacgttgatcatggtaaaacaactcttcttgatactctacgtaattcacgtgtcgctactggcgaagctggtggaattactcaacatattggtgcttatcagattgaagaagctggcaagaaaattactttcttggatacaccagggcatgcggcctttacttctatgcgtgcgcgtggtgcatcagtaactgatattactatccttatcgttgccgctgatgatggtgttatgccgcagacagttgaggcaattaatcactctaaagctgcgggtgtcccaattattgttgctatcaacaaaattgataaacctggtgcaaatccagaacgcgttatcagtgaattagctgagcatggtgtcatctctactgcatggggtggtgagtctgaatttgttgaaatttcagctaagtttggtaaaaatattcaagaattacttgagacagttcttttagttgctgaaatggaagaattaaaagcagatgcagatgttcgtgctattggtactgttattgaagcccgtcttgataaaggtaagggagccgttgcaacgcttcttgtccaacaaggtactttaaatgtacaagatccaatcgttgttggtaatacatttggacgtgttcgtgcgatgactaatgatcttgggcgtcgtgtcaaagttgcgggtccatctacaccagtttctattactggtttgaacgaagctccaatggctggtgatcattttgctgtttatgcagatgagaaagctgcgcgtgctgcaggtgaagaacgtgcaaaacgtgctctcttaaaacaacgccaaaacacgcaacgtgttagcctcgagaacttatttgatacccttaaagctggtgaagttaagtcagttaatgttattatcaaagctgatgtgcaaggttctgtagaagcacttgcagcttctctccttaagattgatgttgaaggagtaaaagttaacgttgttcactcagcagttggtgctattaatgagtctgatgtaacacttgctgaagcatcaaatgctgttattataggatttaacgtacgccctactccacaagctcgtcaacaagcagatgctgatgatgtcgaaattcgtcaacatagcattatctataaagttatcgaagaagttgaagaagcgatgaaaggtaaacttgatcctgaataccaagaaaaaatccttggtgaagccattattcgtgagacctttaaagtttcaaaagtgggaactattggtggatttatggttatcaatggtaaagttactcgtgattcaagtgttcgtgttatccgtgatggtgttgtcatttttgatggtaaattagcaagtcttaaacactataaagatgatgttaaagaagtcggcaatgctcaagaaggtggtctaatgattgagaattataacgatctcaaagaagatgacactattgaagcatacattatggaagaaattaaacgtaaataacccctatgagaaactcaacttgtatctttagttggtagggaaatacaaaattatggctaggctcgtcctagctttcaagttatgagcacaatgaagaaaggattaattatggctaatcatcgtattgatcgcgttggaatggaaattaaacgtgaagtcaatgagattttgcgtctccgagttaatgatccacgtgtacaagatgtcacaattactgatgttcagatgttgggtgacctttcaatggctaaagtattttatactattcattcgacacttgcttctgataatcaaaaagcacaaattggtttagaaaaagcaactggtactattaagcgtgaacttggcaaaaaccttactatgtataaaataccagatttacaatttgttaaagatgaatctattgaatacggaaataagattgatgaaatgttgcgcaatctagataaaaaagattagaatcaagattaagaataataaaaaataaaccatgtcaaaatcatggtttattttttatagctttagagttgagatagctagtattaaggagttttattgatgatatcaatcatttgatactgtgctgttttagcttcttcaatagggtaaattggataaacatgattcattccctcttgtgcaatatagttaacggggtgattagctgcttggagttgtgcagcataatcgcgaatatctgggaagaatatttctcgtgttccagtaaataacgtaataggagcgagtttagtagcaggggcatttttaggactaacatatgtatggttagtattattagaaccatttgcccaaatttcacctacacgtgcgagaccccaagcagataggataggatcagtatcttcgtatttgggaatttctggatgtttcattgtcacatctagccatggagataagaggataatatttttaggttgaggaatagcctcttgccctgattggtgagacaatgcatgcgctaatcctagtgctaatcctccgccagctgaatcacccatcaaagtgagattagcgtttttttcatgaaagtgtctataaaggttaaccaatctagggatagcataatcataggtataacgaggagtttttggataaattggtaaaataatttttgcatcaagactagttgagagcgtcttaagcatgctgatatggtaaggcgttggattatttaagtaagagccaccagctaaatagaaaatggtcttttgattagctttaccgttgtcattccaagaatagacttgcatatcaaaaagtctctcttgaacaagccctccattaacagagtttgggtctaagtaataacccttatcagattgttcacggctagcatttaagtacttttgaaatgagctttcatcttgaactttataataacttttatcgcgctttagccaaaagtattgttcgataaaccaacttttccatgaacgcccacttgcttttgcatgtggtgtacaggcgatggataaaatggtgataatactaaatagtagcaatagttttttgaaggacggtttcaaggtattctccttaatataatgttattttttgtgtaatattattataataaaaccaacatctttgtcaatagaataaagaaagatgagaaatgtttttcggtttacaaatgtagatttatttgctaaaattggtttacaaacgtaaatcgaaagaggtgagaaaatgactatttcaagcgcagaatgggaaattatgagagtggtttgggcacagcagaatacaaccagtaatgagatactagcagttttactagagaagtatgattggactccttcaactgtcaaaaccttattaagaaggctcttagataaaggctacgtgagcagagaaaaaatgggaaaaggatttagctattctcctttaattgatgaagatttagctatgatgtcagaggtagatagtgtatttcaaaaagtttgccagaccaaacatgttgctattgttagacacttattggaaagtataccaatgacagagaaggatcgattaaatttgcaatcatcactagaagctaagaaaggcaaaacacttgaacgtgtagcttgtaattgcattcctggtcagtgtcaatgccattagaaaggagaaaatatggctaatagaaaagaaacatttttgattgatgggatgacttgtgcatcttgtgctttaacgatagaaaaagctgtcaacaagttagaccatgtggatagtgcagtagtaaatttagcaacagagaaaatgacagttacgtttgatgatacaaccttatcgccaaatgtgattgaagagtgtgtttctgagagtggatacgaagcatcgcttttcaaagaggaaacttctaaaagccaatctgaacggcaccaattagccattgaaaagatgtggcatcgcttttggatgtcagcagttgcaactatacctcttctctatatttccatgggaccaatgattaacttatggttaccatcatttttgatgccagataagggacctctaaactatggtatgatacaattattgttaacactaccggtgatgtattttgggcgtatcttttaccaaaatggttttaaagcactttttaaaaggcatcccaatatggattcattagttgctatagccacaacagcggctttcatttatagcttatatggattgtacgaaatattacagggtgacatacactacgctcaccagctttatttcgaatctgttgcagttattttaacacttattactctaggaaaatattttgaaatattatccaaagggcgtacttcggcctcgattgaaaaattattaactttatcagcaaaagaagcaagagttatcaaagatggtgaagactatatggttcctttggataaagttaaaataggtgaaacaattcttgtcaaacctggagaaaaaattcctcttgatggccatgttgtagcaggagaatcaagtattgatgaatccatgttaacaggtgaaagtattccagttgaaaaaaaggttggtagtaaggtttacggtgccagcattaatgggcaaggtagcttaacgattttcgttgaaaaagaagctggcggttcccttctatcacaaattattaacttagtagaagctgcacagacaagtaaggctccaattgctaacttagcagacaaagtatcaggagtctttgtcccttttgttattgtcattgcaattttatcaggcttgagttggtacttaattctggggcaaagttttgccttctctctgaagattatgattgcagtcttagtgattgcttgtccatgtgctttagggttggcaactcctacagctattatggtggctagtggtaaagcagctgagaatggtattttatttaaaggtggtgaagtgttggaaaaggctcaccacattgatacaatagtttttgataaaacaggaaccttgaccaaagggaaaccagaagtagttgctatcaaaacatatgggggagataaagaggagtttttaggtcaggtagcatcagtagaaaaactttcaaatcatccacttagccaaacaattgttaataaagcaaaagagaaagaacttcccttaagggaagtcatggcttttaaaaatattttgggttacggtttgagtgcaactattaatggtaaaactatgcttgtaggtaatgctaacttaatgactaagaacgatgttaatttagatttagcaaaggctgatatagaaatagctcaagaagaagcacaaactgtggtttacgtttccgaaaatggagtgttgagcggtttaataactttaacggaccagctaaagacagatagccaagaaacagttaagcagttacaaagattaggatttaatttagttttacttactggtgataataaggctagtgcagatgccatagcacaaaaattgggtatcacgacagttgtttcagaagttttacctgatcagaaagcaaacgttattttagaacttaaagaaaaaggcggacagattgcgatggttggtgatggcatcaatgatgctcctgcgctagctagcagtgatgtaggtatctctatgagttctggaacagatattgctattgaatcagcagatatcgtgttgatgaaacctgagttaacagatctcttaaaagcaatgactatcagtaaacaaacgattcaaattattaaggaaaatttattttgggctttcttttataacgttttagcgattccagtggcaatgggtgttttacatctttttggtggtcccttactcaatcctatgttggcaggcttagctatggcgtttagttcagtttcagtagttttaaacgcacttcgcttaaaagtcttaaaataataaagataataagactgaatttttatgaagggagaagaatatgaaacatacctatcgagttagtggcatgaaatgtgatggttgtgccaaaacagtttctgataagttatcaagtgtgattggtgttgacgaggttaatgttgatttgactaaaaatcaagttgtcgtaagtggaaaaacattcaaatggcttttaaaacgttctttaaaagacacaaagtattcactagaagaggaaataaattaataactaaagaagtggttacagcttttaatttcttaatttgagcagtttctcacttcttttttattctaaaaatgataaactagaatagaattagttgtgaggagtgcagatgtcaattgatatttggaacattttaagtttggttggaaccgtagcttttgcaagttcgggagctattgtggcgattgaggaagaatttgatattctagggctttttatcttaggttttgtaacggcatttggtggtggagctattagaaatgtactaattggcttgcctattgaaacactttggagtcaaggaattgctttttatgcagcagcagcagctattttatttattatgattttccctaatttgttgagtggtaagggacgggatgccgaagttgtatcagatgctattgggttagcagcgtttagtgttcaaggagcactatatgcgactcaatctcatcaacctcttagtgctgtcattgtcgcagcagtactaactggtgcaggtggtggtattgtcagagatgttctggctggccgaaaacctggagtactaagaagtgaaatatatgcaggttggtcaatattagtggggatcattttatattttaaaattgctaaaacaacaactgactattatttgttagtgttagttgtaactagcctaaggatgttgggttataagaaacaatggcacttgccagttgtcagaccacgtaagaaatgatagaggagaaaaagatgataaaattaattgctattgatatggatggaacgcttttaaatgatgaaaagaaaattccaaaggaaaatatccaagctattaaagaagcaactcaagcaggtattaaaattgtactgtgtactgggcgaccgatgtcaggtatacttccttattttaatgaactaggtttaacaaaagaggagtatattatcatgaataatggttgtagcacttatagcacgaaagattggcaattgattgattctgcaactttaacacatgatgaactcatctttcttgaggaggttgttaaagaatttcccaacgtttgtttaacattaacagctgaaaatacattttacgctgttggagaggaagttcctgaaattgttgcttatgatgctgatttagtttttacaaaagcaaagtcaacaagtttagatgctcttcgcaatcaagaagaaattgtctttcaagcaatgtacatgggattagatgcagatgtaactgcttttcaagaagctgttgaagaagccttaatctcgaaatttagtggagttcgaagccaagactatatttatgagattatgcctcaaggagtaacaaaagcaagaggcttaaaatccttgatagcaaaattaggactggatattaatcaagttatggccatcggtgatgctcctaacgatattgaattattagatttagttcccaatagcgttgctatggggaatgcatcagatgagattaaatctagatgtaaatatataacggtggataataacaaagcaggggttgctaaagctatttatgactatgctttacgttaaaatagatatagaataataaagggaactttaaacactgtttgtttagggttcttttgtttaataaactaacaaaattcagaagtttacagatagcttatgctataatagacctatgacaaacaagaataaattacttttaattgatggctcatctgtagcctttcgtgctttttttgctctttataatcaaattgaccgctttaaaaacaattctggacttcatactaatgccatatatggtttccatttgatgttgaatcatattttaggtcgtgtccagcctagtcatattttagtggcttttgatgccggaaaaactactttccgtacggaaatgtatgcagattataaaggtgggcgtgctaaaactccggatgaatttcgtgaacaatttccttacattcgtcaacaattagatgtcttaggcatcaaacattatgaattggaacattatgaagccgatgatatcattggtactcttgcaaaacaagccgaagctagtaatgaacattttgatataacggtggtttctggggataaagatttaattcaattaacagacactaacacggtagtagaaatctctaaaaagggagttgctgagtttgaagaattcacgccagcttaccttatggaaaaaatgggaattacgccgagtcaatttattgatttaaaagctttgatgggagataaatcagataatattcctggggttactaaaatcggtgaaaaaactggcttgaagttgctatcagaatatggttccttagaagggatctatgaaaatattgaggctatgaaacagtctaagatgaaagaaaaccttatcaatgataaggagcaagctttcttatcaaagaccctagctacaatcaacatagcatcacctataacaatcggcttagaagatatcctttatagtggaccgcaagatataaaagccttgtctcaattttatgatgagatggattttaaacagtttaaagcagctctgggtgaggagacaagtcaggaagattttgaggttgactttactgaagtggagcaattaaaaacagaaatgttctccgataatgatttttattactttgagatgttgggtgataactaccatgtagaagatttaattgggatagcttggggaaatagcgatacaatctacgctactagtaatgtatcgttattgcaagaagctttatttaaaaaagctttatcaaaacctatcaaaacttatgattttaaaagaagtaaggtccttttaaatcgttttaatattgatttaccagagccagcctttgatactagattggccaagtaccttttgtctactactgaggataatctagtatcaacaattgctaggttatatacaaatctgccactggatactgatgatgctgtttatgggaaaggtgctaaacgcgctataccagaaaaaacacgatttcttgagcatctagctaaaaaagtaaaagttttagtggattctgaggctaatattatgcaacagcttaaagctaatgagcaagaagaattgctgtttgaaatggagcaacctttagcgaatgttttagctaaaatggaaattcgaggtattaaggttaagaaaaataccttgaatgaaatggccattgaaaatcaaaaagtcatcgaaacattaacacaagaaatctatgaattggctgggcaagagtttaatattaattctccaaaacagttaggaaagttgttgtttgaaacgttaggtcttcctgtagaaatgactaaaaaaacaaaaacaggttattcaactgcagtagatgtattagagcgcttagctccgatttctcctcttgtaactaaaattttagagtaccgtcaaatcactaaattgcaatcaacctatattattggtttacaagattatattttagaagatggtaaaattcatacacgttatgttcaagatttgactcagacaggtcgtctttcaagttctgacccaaaccttcaaaatataccagttagactagagcaaggacggcttatccgaaaagcttttgttccatcagaagacaatgctgttttattgagttcagattattctcaaatagaattgcgcgtgttagcacatatttcaaaagacgaacatttgatcgctgcctttaaagagggagctgatattcatacttcaacagctatgcgtgtttttggtatcgaaaaacctgagaatgtcactcccaatgatcgtcgaaatgctaaggctgttaattttggaattgtttatggtatttcagattttggtctatcgcataatttaggaatacctcgtaaactagcgaagcaatatattgacacctattttgagcgttatcctggaataaaaaactatatggaaacagttgttcgtgaagcaaaagataagggttacgttgaaacacttttccatcgtcgtcgttcattaccagatattaattctcgtaattttaacattcgccaatttgcagagcgcacagcaatcaattcaccaatccaaggaagtgcagctgatattcttaaaattgcaatgataaatttagatagggtacttgataaaggtggttataaatcaaaaatgctgttgcaagttcatgatgaaattgtacttgaagtccctaacgaggagataggagcaatcagggagttggttacaaaaacaatggagtcagcaattagtttatcggtacctttgattgcagatgagaacgcaggtgagacttggtatgaagcgaagtagtggacaacatacgtaaaggagtcattaatatggtttatcattttcaaaatccaagtgattttatgttaaaaaattatttaacaaaagcaaagaccatcgcagttgtaggactgtcagaccgtcaagaaactgcagcttatcaagtatcaaaaataatgcaagaagcaggttatcaaattattccagttaatcctaaaaatgcaggacagaaaatacttgggcaaatgacatatgcctcacttaaggatgtcactgaacatattgatattgttaatatttttcgacgtagcgagtatttacctgatattgcaagagaatttttagaagtagacgctgatattttctgggctcagcttggacttgaaagtcaagaagcagagacaattctaaagcaagcaggacacaaacagattgtcatgaataaatgtctgaaagttgaatgccaaaaattacactcagaaactaactaattaccgtgtttaataggcaaataatataaattatgctataataaccatgctaaattaaagttcgtgctggaaaggagtcctatggacagtcattcacatggtcatagacctctcgatgcttatgaaaacgtcctagagcatctccgtgaaaaacgtattcgaattactgagactcgaaaagctattatttcctatatggttaatagtcgtgagcatccgagtgcagaaaagatttacaatgatttattaccagaatatcctaacatgagcttggcaacagtttacaataaccttaaggtccttgtggatgaggggtttgtgacagagctaaaactttgcaattatagtacaacttattatgattttatggggcatcagcacctaaacattgcctgtgaagattgtgggaaaatcgttgattttgtcgatgttgacttattggatatttctagagaagcacaccaacaaacaggttttgaagtgactagagttcagttagtagcttatggtatctgtccggagtgtcagaggaagcgtaaggataaatataaaaaagattgaaacgtaattgttcaatctttttttgtttatagactaagagaaaaagtttaagttttactaagtaataattaagaaataatttataattgcttaaaaaatgatttattttttgttggtatactctcattaacaaaaagaaagaggaatcccttatgaaaatatcacaatacaataaatggtcaattcgccgattgaaagttggagctgcatctgtaatgattgctagtggaagcattgttgctttagggcaatctcatattgtttcagcagatgagatgtcccaacctaaaacaaccattacagctccaacagctaacacttctacaaatgtagaaagtagtactgataaggcattatcaaaagttactacgatggagacaagttcagaaatgcctaaaatgcaaaatatggcaaaagttgaaaaaacgagtgacaaacctatgatggtggctacctctgttagaaaaatgatggcaacgccgacacctgtagcgatgaccaaaacgactagtgtagatgaggtaaagaaatcaactgatactgcttttaaacagacagtagacgttccggctcattatgttaatgcagcaaaagggaatggcccatttctagcaggtgtaaatcaaacgattccatatgaagcgtttggtggagatggcatgttaacgcgtttaatccttaaatcttctgaaggagcaaaatggtcagataatggtgttgataaaaatagtccattattaccattgaaaggcttaactaaaggtaaatatttctatcaagtttctttaaatggtaatacgacaggtaaagagggacaagctctcttagatcaaattaaagctaatgataaacatagctaccaagccacaattagagtttatggtgctaaagatggtaaagttgatttaaaaaacatgattagcccaaaaatggtaaccattaacattcctcacattacaactgatatggaagtaaaaaattctctaaagatggcctttaaagaaaaagtagacgtcccagcaaaatatgttagtgctgcaaaagctaaaggtccatttttagcaggtgttaacgaaacgattccatatgaagcgtttggtggggatggcatgttaacgcgtttaatccttaaagcttcagagggagcaaaatggtcagacaatggtgttgataaaaatagtccattattaccgttaaaagatttaactaagggtaaatacttctaccaagtctctcttaatggcaatacagccggtaaaaaaggccaagctctcttagatcaaattaaggcaaatggaagccatacttatcaagcaactatcactatttatggtacgaaagatggcaaagttgatatgaatactattttaggacaaaagacagtgatgattcatattaatgtcgctaaaaaagatatgaatagcacatcaatgatgatgaaaaaagataagatgacaatgcctatgaagaaagaaatgacttcatctaaaataaataccggtatgatgatgtctaacaacaagatgtcagctaatatgcaaatgtcatcacaagccaaatcaaatgataaagctggtaaaaaaatgtctatgatgtctaaaaatttacctaatacaggtgaaacaaagcaacaaaatgtaggtgtgctaggtatgcttagtctagcctttgcgacaggtctaactgcgctaggtcttaaaaaatctaaacaaagatagggatagtatttaattcagaacaccaaatttgtttaaaattattgagggttatcgtggtaaaatagtgttatactagaggtatagcactattttgactcattaggagagtagaatgacacaaaaattattattagttgacgatgaatttgaaattattgatattaatagacgttatctagagcaagcaggatatgaagtgtcagtagctgcggatggcatagaagcactcaaagaggtagatgagaatcgttttgacctaattattagtgatattatgatgcctaaaatggatggctatgattttattagtgaagttctagttcgagaacccaaccaaccttttctctttataaccgctaaagtatctgaaccagataaaatttactctttgagtatgggtgcagatgactttatttccaagcctttcagtcctagggaattagttttacgtgttaaaaatattctaagacgtatctatgggaatcatcaacaatctgaagtgttgacgattggtgatttggttatcgaccaaaaacaacgtttggtaatggtggactgcaatacaatttccttaaccaataaatcatttgacttgctttggatattagcaaatcatttgaatcgtgttttttcaaaaacagagctttatgaacgtgtctggggcgaagaatttttagatgacactaatactttgaatgttcatatccatgccttacgcaatgaccttgctaaatttagtacagacaataccccaactatcaaaacagtttggggattagggtataaattagaggaataaaatgaaattaaaatattatattgttattggttaccttatttctatgttaataactgtagcaggtgttttctttgggcttaatcatatgctgattgagactcgaggtgtttactacatcctttcagttacaattattgcctgtattgtaggtggtatagttaatttgttcttattatcaagtgtatttacatctttgaaaaagttaaaacaaaaaatgaaggatatttctcaaagatgttttgatacaaaagcacaaatttgttcaccacaagaattcaaggatttagagacagcctttaaccaaatgtcttcggagttagagtcaacgtttaaatctctaaacgagagtgaacgcgaaaaaacaatgatgattgcacaactttcacatgatatcaagactccaattacttctatacaatcaacagtagaaggtattttagatggtattatatctgaagaagaagttaactattatctcaataccatttctcgtcaaacaaaccgtcttaaccatctggttgaagaattaagttttattacattagagactatgtcagacacggctgaacctcataaagaagaaacaatttatctggataaactactgattgatattttatctgaatttcaattggtgtttgaaaaagaaaatcgccaagtaatgattgatgttgcgccagatgtttcgaaattatctagtcaatatgataaattatcacgaattttattgaatttgattagcaatgcagtcaaatattctgatcctggaagtcccttgactatcaaggcctattcaaatcgtcaagatatcgttatcgatattattgaccaaggctatgggataaaagatgaagatcttgcttctatttttaatcgtctttatcgtgtagaatcttcacgaaatatgaagacaggaggacatggtctaggtctttatattgcgcgacaacttgcacatcaactgaatggggatattttggtcgaaagtcagtatcaaaaaggcagtaagttctctttagtacttaaattacaaaaatagctaggaattattcctagctattttttgtaatgtttctataaaagattaagcgcgcagtagtttggtaaggaaggagatagatatagactaatccgaaactgaagattgtaaggaactgccaaccaataaaacttaagtctaaaaggaagagtctaagtttattaccattcattagttctcgactagcaaccagtactttagacggtccctcatagtttccactttctaattgagtgtaaaatactaaagttgagatactataggagtaatattgttgaacgagttttataactgccttagtagtaattaggctactaacaactattaaaacaggggcaaggataaggttaccactcaaaagtagcctaaaacttgaaatgatgattagtagaccaaaagtacttagtagataaaagaaagataaaattagtccttttagaacaagtactgagagtaatttccagaaaatatggcttgaaaatacataagtattgtccgagaatctaacgtttagtttctgatttttgacgacatctaacattacaaaactgactgaaataataaaaagtgtgtaaaagaaataaactggaagaggtacaaaaaaatcaagtagtgtcatattattatattgataataaaatgatatatataacgtaataatactaaggagaatcgggagtaaaaaaagttgattcttaccttgaagattgcttaatatagtttttgcctcatttttaatttctgaattcgtcatatctcctccatacacaaaagtacaattcatttcattataacacattccttaagatgagcatgacaagagtacatttttttgataaaatcttaatggctaaaaaagaaattaatacaaagtattacatttagatattgattagcactaaagcccatgactgtttttcatggaagcaaggagaaaacgatgactgatcatccaataaaatatcgattaattaaacaggaaaaacacacaggagccagacttggtgaaataatcacaccacatggtacatttccgacaccaatgtttatgcctgttgggacacaagcaactgttaagacacaatctcctgaagaactaaaagaaatgggttcaggaattattctatcaaatacctaccatttatggttacgtccaggtgatgaattgattgctaaagctggaggtttacataaattcatgaactgggatcaggctattctaacagacagtggaggctttcaggtttattctttggctgatagtcgaaacatcactgaagaaggagtaacctttaaaaaccatttaaatggtgcgaaaatgtttttatcaccagaaaaagctatttcaattcaaaataaccttggttctgatattatgatgagttttgatgagtgtccacaattttaccagccttatgattatgtaaaaaaatcaattgagcgaacaagccgttgggcagaacgtggattaaatgcccaccgccgtcctcatgatcaaggactatttggtattgttcaaggggcagggtttgaggatttacgtcgtcaatcagcacgagatttagtatcgatggattttccaggttattcaattggagggcttgcggtcggagaaacacatgatgagatgaatgcagttcttgattttactgttccaatgcttccgaatgataagcctcgttatttgatgggagttggtgcaccagatagtttaatagacgccgttatccgaggagtagatatgtttgattgcgtcttacctactcgtattgctcgaaatgggacatgtatgacaagtcaaggtcgcttagttgttaagaatgctaaatttgcagaagattttacgcctcttgatccaaattgcgattgctatacttgtaaaaattatacacgcgcttatattcgtcacttattgaaagcagatgaaacttttggtattcgtttgactagttaccataatctttatttccttgtcaatcttatgaaagatgtcagacaagctattatggatgataatcttctagaattccgtcaagattttatggagcgctatggctatggcatgaataaccgtaatttttaaaaaagttcctggtaaaacagggcttttttttgaattgtttgttaaccgtttttttaaaaaagttgacaatagaaaaacttttgtataatatgttataggaggaatcatgatgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccatgattctatttatttttcgaaggagtaatttttaatgtttcacacaaaaagcctaatccagatggctatgatggctactttattggtggtacttggtttcattcctgctctaccacttggtttcattccggtccctatcgtcttacaaaacctaggggttatgatggctggtgttattttgggcggaagaaaagggagtttatctattttgctcttctttcttgtcggtttagttattcctgtattctcaggtttacgttcgactatacctgtattgacaggaccaacagctggttatgttattgcttggttgtttgttcctttgcttatctcatatggtgtaaaattagtaaataaaaagaattttatagctattttccttattgtatggctagcaggggtcctttttgtagatgtagcaggagcagtttggctggcatcttatacgaacatcccattagataaatcacttcttcaaaacttagtatttatcccaggagatacaataaaagccattatagctgctgttgttgctgttaaatataaagatagttttttcttgactgaaaaataatcaagattgctatatattagatggactagtaaatctaaaaatttagatttactagtcttttttgtgcataaaatctaaaacagttattcttaataaaatttggtataatagcattaaatcagtaaggaggggattatcatgaaattaacaacgttaggttgttggggtggttatccttataaagatggaggaaccacaagttttctattaactggagaaaataattttcacttattaatagatgcgggaagtcgttcaatcaatgagctagaaaaagaaataagcccgttggatttggatgcagttatcatcagtcattatcatccagatcatgtagcagatttgggtgtgttgtatcattatcgtttgctataccctaaagataaatgggaacccaaagtattgccagtttatggacataatgaggatgattatgagttttctaaattgacattacctaacgttgctcaaggaattgcttatcataccaatggagttgagcaagttggtcccttcaatattacgtttatcaaaacagtccacccagtcgtctgctatgccatgaggattacagaaagagaaactggtcaagtattagtctttacaggagattctgggtattttgctgaccttgtaccttttacaaaaggcgcagatttatttttagcagacgtttatctttacgagggaaatgaaaatcatattgcacatttgactagtaaagaagcaggtgagattgcttataacgctaaagttaagaaattagttttaacacatgttccgcagtttccgggagaaggaataaaccccgaaaatcatttggaagaacttcgactacagtctgaaaagtatgcaggtggcatctctgttgatttagctcagccacataaatcttgggacttaggaaaactataatgcagaaatttacccaagaagaaaaagaatggtttatgacagaagctctaaaggaggcaaaatcctccttagagaaagaagaaattcctataggttgtgtcattgtaaaagatggtcatattattggaagaggacataatgctcgtgaagagtttaataaagctattttacatgctgaaatcatggctattaacaatgcaaatgagaaggtagggaattggcgcttattagatactactttatttgttactgtagaaccttgtgtaatgtgtagtggagctattggcttagctagaattccccacgttatatatggcgctaagaatacgaaatttggagcagcgggaagtctctatgatattttaagtgatagccgacttaatcatagagttgaggttgaaaccggcattttagaagatcaatgcgctaaaataatgcaggatttctttcgaaaaggacgacaacgcaagaaagaagctaaactaagtgaaaaaactaagatttgatagcttgcaataaaatattagttttgttataatatctttggagcaacatttactcgtgaagtgggtcaggggaggaatccagcagccctaagcgatgctaaatgtgtgctctttttattttcaaaagtcaaagtgtttttggaaataattatgaaagtttcataaaaattggtagcgtttcaaaaaatatgaaaatacagttaaaaaaccttgaaaaaaaactcacaaaagagtaagatgatagtgaaacataattgttaggagaaataaaatgacacatattacatttgactattcaaaagtcttgggtcaatttgtaggcgaacacgagttagactacctacaaccacaagtaagtgcagcagatgctttccttcgtcaagggactggtcctggctcagattttctcggatggatggacctcccagaaaactatgacaaagaagaattttctcgcattcaaaaagccgctgaaaagattaaatcagatagcgaagtactcgtggttattggtattggtggttcgtaccttggcgcaaaagcagcaattgactttttgaataatcattttgctaatttgcaaaccgcagaagaacgtaaagcgcctcagattctttatgctggaaattctatttcatctacttaccttgccgatttagttgaatacgtccaagataaagaattctcagtaaatgtcatttcaaaatcaggtacaacaactgaaccagcgattgctttccgtgtatttaaagaacttctagttaaaaagtacggtcaagaagaagctaataaacgtatctacgctacaactgataaagttaaaggtgccgtaaaagttgaagcagatgctaacaattgggaaacatttgtagttcctgataatgttggtggtcgtttctcagtactgacagccgtaggtcttcttccaattgctgcttcaggagcagatattactgctcttatggaaggcgcaaatgctgctcgtaaagatttatcttcagataaaatctctgaaaacattgcttatcagtacgctgcagttcgtaatgttctttatcgcaaaggttatatcacagagattttagctaactacgaaccatcattacaatactttggtgaatggtggaaacaattagcaggtgaatcagaaggtaaagatcaaaaaggtatctatcctacatcagcaaacttctcaactgatcttcactcacttggtcaatttattcaagaaggttaccgtaacctctttgagacagttgttcgcgttgagaaacctcgtaaaaatgtgactattcctgaattaaccgaagatttagatggtcttggttatcttcaaggaaaagatgtagattttgttaataaaaaagcaacagatggtgtactccttgctcatacagatggtggggttccaaatatgtttgtaacgcttcctacacaagacgcttacacccttggttacactatttacttctttgagttagcaattggcctttcaggttatcttaactcagtaaatccatttgatcaaccaggggtagaagcatataaacgtaatatgtttgctcttctaggtaaacctggattcgaagagcttagcgctgaattgaatgcacgtctttaaaaatatctaactaaaaagttcctcaaagagaggaactttttagttttgttgtaggataactaaaaacccactagcaccggtagcgatagtgggttggaaaaagggttgagaaaagttattaacttttctcaggagatttatgaaaaaggaaaataatttaggataatattttcctaacggctaggataaaccgcttattttaggatgatactagtatacagtagaaaccttaaataaaccttaaaaattcatactttatcattttattttcccctatactatttttgtataaatggtcaatattaatggtatcatagatatatggaaaagaaattattaagaaaagaagttttgataaccttaaaatctcaacctcaagcttacaaatcagaagttgactgtaaacttttagaggcttttataaaaactaaagcttatcaaaatagttgtgtaattgctacttacctatcttttgactacgaatacaatacacaacttcttattaaacaagctttatgtgatggcaaacgtgtccttgttcccaaaacttatccaaaaggtaaaatgatttttgtggactatcaaaaagataacttgaggacaacaccgtttggcttattagaacctgttaatgatagagctgttgaaaaagctagtatagacttaattcatgtgcccggacttatctttaacaataaaggttttcgtataggttatggtgcaggttattttgatcgctatttgagtgattttgaaggtgatactattagtactatttataggtgtcagagacaggattttgtagaagagaagcatgacgtagcagttaaggaggtattatgtctatgaagaagttcgctaaagagtatccgacgacagtactcttggtcagtctgacaacccttgtttttttattgatgcaactaacttatggaagtcaagcggagtctagccaagttatttttcaatttggtggaatacaaggtgattatctaaaagcatatccaacaaatctatggagactaataagtcctatctttgttcatattggttgggaacattttttattaaatggtttagctctgtatttcgtaggacaaatgggggaaagtatttggggaagtttgagatttctaattctctatattttatctggcttaatgggtaatatttttacgctattttttactccacatgtggtggcagcaggagcctcaacgtctttatttggtgttttttctgctatagcaatcgcagggtattttggaaaaaatccttatttaaaacaagttggaaaatcatatcaagtgatgatcttgttaaatttattttttaatatcttcacacccggagtgagtttagcaggtcatgttggtggtttagttggtggagtattggtggctatttttttgacaaaacaaaatggttctttattatttaaaacttggcaaagtattttagctttaatgatatttattattgtatcgatcagcttaataggtctatcgttggtataattctacggctatagcctctaaaaccaaactttctctgggaaaaatagaataaagtttgctaaatgatttttttatgttatgatagaaatctgtttttatgtgactataacttattaggaggttcattctcggtgaacagaaaaattattggcttaactctactatctttatctgtactaacattaacagcatgtggtaatcgttcagataagtctgcaaataaatcagatatcaaagttgcgatggtaactaatcaaggtggagtagacgataaatcgtttaatcaatcagcttgggaagggctacaaaagtggggaaaaaagaaggggttgacaaaaggtaatggctttgattatttccagtcatctaatgaatcagatcatgctaataaccttgatacggcagcctctagtggttataatttaatttttggtattggatttggtcttcatgatactattgaaaaagtatcagaaaataataaagatgttaaatacgttattgtagatgatatcattaaaggtaaagaaaatgtagctagtgttacttttgcagacaatgaagctgcttacttagctggagttgctgcagctaagacaactaagacaaaaacagttggttttatcggagggatggaaggcgtcgttgttaagcgatttgaagcaggatttaaggctggagtaaaatcaattgatccggctattaaagttgcggtatcttatgcaggctcatttacagatgcagctaaaggtaaaacgattgctgccacacagtatgcaacaggtgttgatgttatttaccaggctgctggtggtacaggagcaggaatttttagtgaggctaaaactgaaaatgagacccgcaaggaatctaacaaagtctgggtaattggtgttgacagagatcaaagtcaagaaggcaattatgtttcaaaagatggtaagaaagcaaactttgttctggcatctactataaaagaggtggggaaatctctccaatctgtagcagaattaacagagaaaaaacaatatccaggagggaaagtaacagtttttggtctaaaggatagtggtgtagatattaaagagcatcaattgtctagtgagggatctgttgctgtcaaaaaagctaaagaggatattgtttcagggaaaatacaagttcctatgaaatgataaaagtgtggaggaacaataagttcttcgtcaagtacaataaaaaagtttcctatttaggaaacttttttattgtacttgactcatattttacttcttagatgttttttctagagattttcctaaatcaatgatatatttcttcaagtcatctttaacttgtgggtgttgaagagcataatcaatagatgttttcataaaaccaaacttgtcaccaacgtcgtaacggtctcctgtaaattttctagcaaaaacacgttgcgttttatttaaagtatcgatagcatcggttagttgaatctcatttcctgcaccaggtttttgagtttctaaaatattaaaaatttctggagttaacaagtagcgaccaatgattgccaaattacttggagcctcttcgggagaaggtttttcaacgaaagtgttaacgctatatagaccattaactccttctccttgtggagcaataacaccataagcagaaacatcttcatgtggaacttccataacagcaattgttgatgcatgagtagcttcaaagtcattaattaattgtttggtgagaggaataactttattattggtaatatccattagatcatcacctagcataacaacaaaaggttcattaccaacgaaggcttttgcttgtagcacagcatctccaagcccacgaggatgactttgtcgaataaaatggagtcgaatgccagttgtttcatcaacaagtttgagaagttcgtttttccctttctcttttaggttatattctaattcaaaatttgaatcaaagtggtcttctatagaacgttttgatttaccagttacaactaaaatatcttcaattccagattttagtgcttcttcaacaataaattgaatagttggtttatcaacgattggaagcatttctttagctaaagctttagtagcaggtaaaaaacgtgttcctaaaccagcggcagggataactgcttttctgactttcatatatagctcctttaaatagtattaatataaacgatattagtgccattcattctctgaacgaaattcattggacatcatatctaaaatgctatctttgatattagccccttcatatattgatttataaatagcttctgtaatgggcatgtaaacatttaagttttgggcgatttcgtaagcaactttagttgttgagataccttcaataaccatccccatatttttttcaatatcttcaagtttctcaccacgtcctaaagcatctcccgctctccagttgcgagaatgaacagatgtaccagtcacaattaaatctccaactccggataaaccactgaaagtgagagggtcggcccctaattgtacaccaagacgtgttatctcagctaaaccacgcgtaataatagctgctttagcattatcaccataaccaagaccgtgtagtgctccagcaccaacagcaataatattttttagagcaccagctgtttctactcctacgacatcagtgttagtataaagtctaaaataatgattactaaacaatttttggacatacttagctgcttcaatatcttttgaagcagcagtaatcaaagtaatatcacgaacgatggcttcttcagcatgactgggacctgaaacaacaacgatatcactacgatattgttcagagatttcttcttctaaaattgtagaaagtcgttcatgagtaccaggttctagtcccttagaagcatgcataagaacaactttatgctttaaaagattagccacttgtttagcaacaagtcttgtaactttagttgggacgacgaataaaatgctgtcaacattattaatcgcttcctcaagattagtgtaggcttttattttggaatctaaggtaatatctttgaagtaacgttgattagtatggttagtattaatctcttctatttgttcaaccacgtttccccataagcgtacctcatgtccattgtcatttaatacttgtgcaagagcagtcccccatgaaccaggtccaagaacggcaattttttgttttgtcatcttattccttctttctaataataaggcatatagcgctaacattatatcatactctaatacactttgtcttgtttagtctgttgtcaatgatagtaacattagaaaagaattgagtcttttaggttatttatggtataataaaaccaatttagataaatggagcactattttgaaaaaaacctatcgggtaaaaagtgataaggattttcaaatgattttcagcagaggtaaaaatgttgctaatcgaaaatttgttatctactatttagaaaaagaacaaaaacactttcgtgtgggaatctctgttagtaagaaattaggaaatgctgttgttcgtaacgctattaaaagaaaaattaggcatgttttactctctcagaaaacagcgctgcaagattatgattttgtcgtgattgcgcgtaaaggtgtagaggaattggactatcaagcattagaaaaaaatcttatacacgttttaaaaatagcaggactcatctagaaaggtataaaattgaagaaaaaacttaaaacatttagcttaatattgctgacaggctctttattggttgcttgcggacgaggagaagtatctagtcattcagccacattatgggagcaaatagtttatgcatttgctaaatcaatacaatggctctcctttaaccattcaattggtttgggaataatcttattcactctaataatcagagcgattatgatgccgctttataatatgcaaatgaaatccagccaaaagatgcaggaaattcagccaaggctcaaggaattacaaaaaaaatatccagggaaagatcctgataaccgtttaaagctaaatgatgaaatgcaatctatgtataaagctgagggagttaacccatatgcaagtgtattacctcttctaattcagttacctgtcctatgggctcttttccaagctttgactagggtttctttcttaaaagtaggaacatttttgagcctagaattatcacagccggacccatattatattttacctgtactggcggccttatttacctttttatcaacttggttaactaacaaagcagctgttgaaaaaaatattgctttaactcttatgacttatgttatgccgtttatcatattggtaacaagctttaactttgctagtggtgttgttttatactggacggtgtctaatgcttttcaagtatttcaaattctattattgaacaacccatacaagattataaaggttcgagaagaagcagtaagagtggcacatgaaaaagaacaaagagttaaacgtgctaagagaaaagcaagtaagaaaagaaagtaggaaaaccatggtattatttacaggagcgactgtagaagaagctattgaaaaaggactacaagagttaaacatttcacgattgagggcacatataaaagttgtatcacgtgagaaaaaaggttttttgggctttggtaaaaagccagcaaaagttgaaatagaaggtatcaccgacgaagtaactgatattaatgaatcggtagcgttaaaaaatattaagaatgtaccgtctagcgtagatgtggtggaagaatatatagaggaggttgatgaaacgcttgaaaaagaagacgtatcacaaccagaacttccaaaaattgatgataaaaacgttgtaactacaagtgaagctattgaaaaaattgacctacttcctaatattgaagtagcagctgctcaggtgactaaatacgttgaaaatatcatctatgagatggatttagatgcaacaatagaaactacgacaagtaagcgacaaataaatctccaaatagaaacgccagaagctgggcgcatcattggttatcatggaaaagtattaaaatcgttgcagttgttagcacaaaattatcttcatgaccgcttttctaagagtttttcagtatccattaatgtccatgactacgttgagcatcgtacagaaactttaattgatttttctaaaaaaatagctaggcgtgttttagagactaatgaaccttaccatatggatcctatgagtaacagtgagcgaaaaactgttcataaaacaattgcaactatagagggtgttgaaagttattctgaaggtaacgatcctaatagatttgtagtagttactaagaaataaaaagaggtgagacctctttttttcttgcgctctatctacattttcagaaaatgtagaaaaagtatgaaaaaagagttgacaaagtaagagatgatgtagtaaactaaataagttgtctcgagagagcagtttctattagcgcgtagttaacaacttaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccatagaagcgggtgtagtttagtggtaaaactacagccttccaagctgttgtcgcgagttcgattctcgtcacccgctttactttataagaaagtaaaaaccaagcaatagcttgggcgcgtagctcaggtggttagagcgcacgcctgataagcgtgaggtcggtggttcgagtccactcgtgcccatcaagaatatggtccgttggtcaaggggttaagacaccgccttttcacggcggtaacacgggttcgaatcccgtacggactattcttaaaaaagtagaaagtgatctttctactttttttattttaagtatatatttttgcaatagtattgtaattaaatttgatattaataaaaacacactatttagtgtgttagttagcgctttttcaattcaaggtaccgtttataccagatattgatatatgatgatgaaaaggggcctttattctcatttatccattctaccaatatttttacattttcctttaatatataatcaatatcggtaggatagttcatctgagctttatgctgttcatattcgtccacatctagtagtcttttttcaccatctgcaaatactttgacatcaaggtcatagtcaatatacttgagtgcttcagggtccaagatatacggacttgctagattacaatagtaggagacaccagtttcacgtatcatagcgataatgttaaaccagtattttttatgaaagtatactattgcaggctctcgtgtcacccagcgtcgaccatcattttctgttactaaagtatgatcattaacaccaatgagggcattttcggttgtttttaataccatggtgtcacgccaagttcggtgtaaactaccatcatgtttgtaactttgaattgtaataaagtcgccttctttaggtaatctcatagcctaccaactttctacaatttatacgtctgttatagtttatcataattttctgtaaaatacatcgtctgagagttattatcttataaatattctcttaaagcacttttgatatcttcgtactggtatcctttacgcattaaggcattgattatacgttgctttaattcatactggtcatgtttttttgataatttttggtattgtttatctaattctttataaatgaggtcttcttcaagttcttgatctttttcaatttcaaggttttgaattacggtatgcactatctgataatcaaatccttttgtagttaagctctgcatcaatttatcttttaatgcttttagtggaagtttgttttgatattttttatagagtttttggcttattttggatgctaagtcttgaaagtttatagcttgaagttcagattcaattattttacttttgatacctttttgcaataatttttgttttatcacgtatggtcccttatcgccagtatttagattttgctgtatgaaagattgcacgtagtttttatcgtttatccaattctcactttttagattatcaataatttgtggaataattttagaatcaatatcatgttgttgaagatatttaataacttctttctcggttctctgcttgaaagaaatataataaagacctagatttttaccgtatgatagttgggcaaattttttaatattttcaagtttctcggcattaattatcatccctttacttaacataaaatgaacgatagtatcttctgttatatataaattttcggtattgtctagctctagagtgtaaagtctttttttcttttcgattttggttattttcatagtttttattatagcaaaaatgataaaatagtaaaaatgagtctttttttaaatgttatggatttatagtattttcttagttagggagtaatgaactgatgaatgtggttttaaaacagcgaattcctttaaaaattaaacgaatgggaattaatggtgaaggaataggtttttataaaaaaacactaatctttgttccaggggccctcaagggagaagaggtgttttgtcagatttcttctgttagacgtaattttgcagaagctaaactgttaaagataaataaaaaatctaaaaatagggtagaacccccttgttctatttataaagaatgtgggggatgccaaataatgcaccttcaatatgataagcagctagagtttaaaacggatgttattcgacaggctctaatgaaatttaaaccagagggatatgagaattatgaaatccgtaaaacgataggtatgtcggaacctgaacactatcgtgctaaattacaatttcaagtgcgttcgtttggagggaatgtaaaggcaggtttatatgcacaagggacacatcgattgattgatatcaaagattgtttagtgcaagatagccttactcaggaaatgataaatcgagttgcagaacttttaggaaaatataaattgcctatttataatgaacgtaaaatagctggtgtccgtactgttatgattcgacgagcacaagcgagtggagaggttcaactgatctttatcacaagtaaaagacttgattttgatgatgttgttattgaattagttcgagagtttcctgagttaaagacagttgctgtaaatatcaacgctagtaaaacaagtgatatctatggtcaaataacagaagttatttggggtcaagaatccatcaatgaagaagtattagattatggtttttcgttatcaccacgtgctttttatcaacttaatcctaaacaaacacaaattttatatagtgaggcagttaaggccttagatgtgaaggaagatgatgatttaattgacgcttattgtggagtaggaacgattggacttgcttttgctggaaaagttaaaagtgttcgtggaatggatattatccctgaggctattcaggatgctaaagagaacgcactttatatgggttttactaatacacattacgaagctggaaaggcagaggatattatccctaggtggtatagtgagggatttcgcgctaatgcgttaatcgtggatcctcctcgcacaggtttagatgataaattgctaaatactatactaaaaatgcctccagaaaaaatggtttacgtttcttgtaatacatccacgcttgctagagacttagtaacattaacaaaagtataccatgtccactacatccaatccgttgacatgtttccacatacagcaaggaccgaggctgtagtgaaactacaacgtaaggaataataaagttttctaatcaaaaaataagagtatttttgggtattcttatttttagatagtaatggtgagatattaatataacatagtctaaaaacacatggtttaagctatttgatacggaaatttaccttagaaatggtaaatagttccattaagtatattcatctttgcaaatttgaccttgccttttaagtttcattgagttaaaatagaaaaaatatttttaacaagatgatagaacatcgtaaattaaggtttaaaggaaatgcttatgataataaattcattcgataatagtagaaaagcgattattaatcctgaagatattaattcaccaataaaaggttttccaaagactgttattacctgtttcgcgcgggagactttcaatcgtattttagaagaattgcctcatcgtgaaattgctagaactagtgtagcaaacttagaaattcccatttatgaattagaatttaaaggacaaaagattggctttttcaatgcttatgttggtgcttcagcttgcgtagcaatcttggaagatattatagtatttggaatggaaagtttaattgtttttggaacatgtggcgtccttgattcgtcaattgaggagacatccattattattccaagaagtgctattagggatgaagggacatcatttcattattcggaagcaagttctgaaattgcagtaaacacaaattcaatttttttactctgcggataatttagatgcagaagtatgggaagcaagatctttaggaaatagcgaggatttagaaaagaaagataaaattgcttatattgccatggagtttgctatagagactttttagggtctactgtatgatgttgaaaggaagatagcaatgtggaatgtaaaaacttttgataatttaactacacatgagttgtttcaaatatataaattaagagtatctgtatttgtggttgaacaagattgtccttatcaagaggttgatgatgaagatttgatttgtttgcatgggatgaattgggtagatggtcaattggcagcttattatagattgataccagaagatgataaggtgcatttgggacgtgtgattgttaatccagactttagaaaaaagggattaggaaatcaattagtggaatatgcgattaaatttagtgaggcaaattaccctaataaacctatttatgctcaggcccaagcttatttacaagatttttatcaatctttcggatttcaacctgtctcagatatctatctagaagataatattcctcatcttgatatggttttattataaatacatgctatttaaactatcaattaaaaggtctctcagtattgctgagagatcttttaattaacaaaaaattaaaaaatttaaattaaaaaataaaaataaaatttatcgctaattattctattgctaataaattaattatgttgtaatatagtatgcatactgatttttggaggaaataggaaaagtggataaacatcactcaaaaaaggctattttaaagttaacacttataacaactagtattttattaatgcatagcaatcaagtgaatgcagaggagcaagaattaaaaaaccaagagcaatcacctgtaattgctaatgttgctcaacagccatcgccatcggtaactactaatactgttgaaaaaacatctgtaacagctgcttctgctagtaatacagcgaaagaaatgggtgatacatctgtaaaaaatgacaaaacagaagatgaattattagaagagttatctaaaaaccttgatacgtctaatttgggggctgatcttgaagaagaatatccctctaaaccagagacaaccaacaataaagaaagcaatgtagtaacaaatgcttcaactgcaatagcacagaaagttccctcagcatatgaagaggtgaagccagaaagcaagtcatcgcttgctgttcttgatacatctaaaataacaaaattacaagccataacccaaagaggaaagggaaatgtagtagctattattgatactggctttgatattaaccatgatatttttcgtttagatagcccaaaagatgataagcacagctttaaaactaagacagaatttgaggaattaaaagcaaaacataatatcacttatgggaaatgggttaacgataagattgtttttgcacataactacgccaacaatacagaaacggtggctgatattgcagcagctatgaaagatggttatggttcagaagcaaagaatatttcgcatggtacacacgttgctggtatttttgtaggtaatagtaaacgtccagcaatcaatggtcttcttttagaaggtgcagcgccaaatgctcaagtcttattaatgcgtattccagataaaattgattcggacaaatttggtgaagcatatgctaaagcaatcacagacgctgttaatctaggagcaaaaacgattaatatgagtattggaaaaacagctgattctttaattgctctcaatgataaagttaaattagcacttaaattagcttctgagaagggcgttgcagttgttgtggctgccggaaatgaaggcgcatttggtatggattatagcaaaccattatcaactaatcctgactacggtacggttaatagtccagctatttctgaagatactttgagtgttgctagctatgaatcacttaaaactatcagtgaggtcgttgaaacaactattgaaggtaagttagttaagttgccgattgtgacttctaaaccttttgacaaaggtaaggcctacgatgtggtttatgccaattatggtgcaaaaaaagactttgaaggtaaggactttaaaggtaagattgcattaattgagcgtggtggtggacttgattttatgactaaaatcactcatgctacaaatgcaggtgttgttggtatcgttatttttaacgatcaagaaaaacgtggaaattttctaattccttaccgtgaattacctgtggggattattagtaaagtagatggcgagcgtataaaaaatacttcaagtcagttaacatttaaccagagttttgaagtagttgatagccaaggtggtaatcgtatgctggaacaatcaagttggggcgtgacagctgaaggagcaatcaagcctgatgtaacagcttctggctttgaaatttattcttcaacctataataatcaataccaaacaatgtctggtacaagtatggcttcaccacatgttgcaggattaatgacaatgcttcaaagtcatttggctgagaaatataaagggatgaatttagattctaaaaaattgctagaattgtctaaaaacatcctcatgagctcagcaacagcattatatagtgaagaggataaggcgttttattcaccacgtcagcaaggtgcaggtgtagttgatgctgaaaaagctatccaagctcaatattatattactggaaacgatggcaaagctaaaattaatctcaaacgaatgggagataaatttgatatcacagttacaattcataaacttgtagaaggtgtcaaagaattgtattatcaagctaatgtagcaacagaacaagtaaataaaggtaaatttgcccttaaaccacaagccttgctagatactaattggcagaaagtaattcttcgtgataaagaaacacaagttcgatttactattgatgctagtcaatttagtcagaaattaaaagaacagatggcaaatggttatttcttagaaggttttgtacgttttaaagaagccaaggatagtaatcaggagttaatgagtattccttttgtaggatttaatggtgattttgcgaacttacaagcacttgaaacaccgatttataagacgctttctaaaggtagtttctactataaaccaaatgatacaactcataaagaccaattggagtacaatgaatcagctccttttgaaagcaacaactatactgccttgttaacacaatcagcgtcttggggctatgttgattatgtcaaaaatggtggggagttagaattagcaccggagagtccaaaaagaattattttaggaacttttgagaataaggttgaggataaaacaattcatcttttggaaagagatgcagcgaataatccatattttgccatttctccaaataaagatggaaatagggacgaaatcactccccaggcaactttcttaagaaatgttaaggatatttctgctcaagttctagatcaaaatggaaatgttatttggcaaagtaaggttttaccatcttatcgtaaaaatttccataataatccaaagcaaagtgatggtcattatcgtatggatgctcttcagtggagtggtttagataaggatggcaaagttgtagcagatggtttttatacttatcgcttacgttacacaccagtagcagaaggagcaaatagtcaggagtcagactttaaagtacaagtaagtactaagtcaccaaatcttccttcacgagctcagtttgatgaaactaatcgaacattaagcttagccatgcctaaggaaagtagttatgttcctacatatcgtttacaattagttttatctcatgttgtaaaagatgaagaatatggggatgagacttcttaccattatttccatatagatcaagaaggtaaagtgacacttcctaaaacggttaagataggagagagtgaggttgcggtagaccctaaggccttgacacttgttgtggaagataaagctggtaatttcgcaacggtaaaattgtctgatctcttgaataaggcagtagtatcagagaaagaaaacgctatagtaatttctaacagtttcaaatattttgataacttgaaaaaagaacctatgtttatttctaaaaaagaaaaagtagtaaacaagaatctagaagaaataatattagttaagccgcaaactacagttactactcaatcattgtctaaagaaataactaaatcaggaaatgagaaagtcctcacttctacaaacaataatagtagcagagtagctaagatcatatcacctaaacataacggggattctgttaaccataccttacctagtacatcagatagagcaacgaatggtctatttgttggtactttggcattgttatctagtttacttctttatttgaaacccaaaaagactaaaaataatagtaaataaaactaagtaaactactcggcaatatgatgaaaagttcagtttaacattatgttaagctggacttttagggtattgactcttatttttgattaattttatattgattaatgacatataatattataatattataattacgattagtatgtgataccgttcactttgtaagctttcataagatgaactagccttaaggagttttgatagcaatgaaaacgataaaagattggcaaataaatatttgcttagcgacctataatggtcaaaaataccttcgccagcaattagatagcataatacaacaaggttatactgactggatttgtttaataagggacgatggatctactgatgatacagtagctattattaaagaatatgttaatagagattcacgttttatatttattaattctaacgatgacagaaagttaggaagtcaccgcagtttttacgagttggttaactataaaaaagcagatttttatgttttctcagaccaggatgatgtttggaaagaaaatcgtttagaacgttaccttgaagaagcagagaaatttaaccaagaactaccattgcttgtttattcgaactggacttctgtagatgaaaaattaacagtattgaaagaacataatccagcaacagttattcaagaacaaattgcctttaaccaaataaatggtatggttatcatgatgaatcatgagttagcaaagctttgggaatatcgtcaaattggcgcccatgattcttatgttggaactctagcttacgccgttggaaatgtggcttatatttctgacagtacagtcctttggcgtagacaagtaggggcagagtcgctaaacaattacgggagacaatatggggtggctacgttttggcagatgataaatacttcttttgatcgtgcttcgcttatttttgctcaagtatccgataaaatgtccctggagcgtaaactcttctttagtcgttttatagaattaaaaaatgccaatctaatgagaaggatttatcttttatcaaaattaaaactccgtcggaaatcattgaaagaaacagttgctatgactatcctacttttaacaggttacggtaaaccaaaagcataatttttttggttgaaggaaatcaagttgagttgtagttaaaaatatagaaaatatttatttttcaaaaagttgttgacacttaacgaaattagtatataataatattaaagaacaaggtagaaccttggctcgcattaatttcgggttttggaaaaggagtagcaatcgctactccttttttgttttacacaggaaaagtatgaaggtaaagcctttttttataaaaattaggcttgcttaattttttaatttttatattctttacattatgatgaaaacacaagatatagtggtgatatatgttgaaagacacaaaactttgtgttagtatactgtttaagcagatccttaataaaggtaaccgacaaaaaagtttaacgtaacttaacaaaacagtggttttgaagcaagagttagcttcttaccagaataaaaaaacatcaagaagaacattccaatagttgtgtgattttaacaaaaatccagtcctcttgggaggcttttttggtgcttaaaactcgcttaattttaatatttaggagactagtttaatgcaatcatactatgatcgttctcaatcgccacttgactatgccttgtcagaaaaagcttttcctatgcgttctgttaattggaataagctaaacgatgacaaagacttagaggtatggaacagagtaactcaaaatttctggttacctgaaaagatcccagtttctaatgaccttaattcttggagaacattggatgctgattggcagcaattaattactcggacttttactggtctaaccttattagattctgtgcaggctactgttggtgatattgctcagattaagcattctcagacagatcatgaacaagttatttatgctaactttgcctttatggtagctattcatgcgcgatcttatggaacgattttttcaaccttatgcactagccaacaaattgaggaagcacatgaatgggtagtggatactgaaagtctacaagctcgatcacgtatacttattcctttttatactggtgacgatcctttgaaatctaaggttgctgcagccatgatgccaggatttttgttatatggtggcttttaccttcctttttacctttcagccagaggaaaattaccaaatacgtctgatattattcgtttaattttacgagataaggtaattcataactattacagtggctataagtatcaacagaaagttgctaaattatctgtagaaaagcaagccgaaatgaagacatttgtctttgacctcctctatcagttgattgatttagaaaaagcctatctttacgaactatatgatggttttgatttggctgaagatgcaatcagatttagcatttacaatgctggtaaatttttacaaaatttaggatatgattctccatttacagaagaagagactcgtatatctcctgaggtttttgcacaactttcggcgcgtgcagatgaaaatcatgatttcttctcaggaaacggctcttcatatattatggggattacagaagaaacattggatgaagattgggagttttaaatggatagtacagtgaaggtggtctatttttcatcgaaatctaacaatacccatcgttttgttcaaaagttggcttgttctaaccagcgtattccatcagatggtagtagtatattggttactgaggattatattttgattgtgcctacttacgctggaggaggagatgataccaaaggcgcagttccaaaacaagttgtacagtttttaaatgttcgacaaaatcgggaacattgccaaggggttatttcttctggaaataccaattttggtgacacttatgccattgctggacctattattgctcgaaaattaaatgttcctttgcttcatcaatttgaattactgggaacacaagaagatgttacaagggtaaaggagttactttgccaattcactagaaaggataaataagatgacacaatcagatgcatatctctcgttgaacgcgaagacacgctttagagatcgcacaggtaattatcattttacttcggataaagaggctgttgaacaatatatgatagaacatgttgaacctaatacgatggtgttcacatcactaattgaaaagctagattatttggtttctaataactactatgaatcggaccttctaaaacaatataaccttgagtttatttgccaaatttttgagcatgcatacgctaagaaatttgcttttctaaattttatgggggctttaaaattttataatgcttatgctcttaaaacagaagacaatcgttattatttggaacactatgaagatcgtgttgtaatgaatgctctgtttttagctgctggtgatgaaaaagctgcctatgacctagtagatgacatgctagcaaatcgctttcaaccagcaacacctacctttttaaatgcagggaaaaaacgtcgtggtgaatatatctcttgctatttgttgcgcattgaagacaatatggaatctatttctcgtgctattagtacaagccttcagttatcaaaacgaggtggtggggtagcactttgcttaaccaacttacgggaatttggtgctccaataaaaggtattaaaaatcaagctactggtattgtacctgtcatgaaattactagaagattcgttttcttacgccaatcaattaggacaaagacaaggagctggtgcagtttacttacacgctcaccatcctgaagtattaacgtttttagatactaaacgtgagaatgccgatgagaaaattcgaattaaatctctttccctaggacttgttattcctgatattacttttgaattggctaaggcaaataaagatatggccttgttttcaccgtatgacattgagcgagtatatggtaaaccaatgtctgatatctctatcacagaagaatatgaaactttattagccaatgcggatattcgtaaaacctttattagtgcacgaaaactatttcaaacgatagcagagcttcattttgaatctggttatccttatatcttatttgaagatactgtaaatgctaaaaaccctcacaaaaaagagggacgaattgttatgtctaatttatgttctgagattgcacaagttaatacagctagtcaattttcagaagacctgactttcactaaggttggacatgatgtttgttgtaatttaggttctattaatattgcgcgtgctatggatcaagcggcggattttgaaaaattaattgctaatagcattagagcccttgatcgtgtatctcgaacttctgatttagatagtgctccatctattaaaaaaggtaatgcagctaatcatgctgttggtttaggtgctatgaatttgcatggatttttggcgactaaccatatttattacgattctcaagaggctattgattttacagattgcttcttttacgctatggcttattatgcctttaaagcttctaaccatttagcaaaagaaaaaggaacctttgagggcttctcggaatcaagttatgctgatggcagttatttctatcaatataccgaacaaaactttgagccaaaaacacagcgtgttaaaaatctactagctgagtatggtctgactctaccaagccaagaggattggagaaagcttgtgcaaagtattaaagagataggattagctaatgcgcatttattagctgttgctccgacagggtcaatcagttatctttcttcttgtactccgagccttcaaccggttgtatcacctgtcgaagtacgcaaggaaggagcactggggagggtttatgtacctgcttataagattgatgcagataattatgtctactacaaaaaaggagcttatgaagtgggatctgaggcgattatcaatattgcagctgccgctcaaaaacacattgatcaagctatttcgttaacgcttttcatgacagatcaagcaactacgcgagatttaaataaagcctatattcaagcatttaaacaaaaatgtgcctctatttattatgtacgagtgagacaggacatcctagaaggtagcgagagttatgatgatatgctggatgatttcacttcatcggacttagaagactgtcaatcctgcatgatttaactaaatatactcaatcagaagattaagagaaatatattggcttttagaaaggctttattgtaatgacaaaaaaacatcttaaaacgcttgccttggcacttactacagtatcagtagtgacatacagccaggaggtatatggattagaaagagaggaatcggtcaaacaagaacaaacccagtcagcttcagaagatgattggttcgaagaagataatgagaggaaaacaaatgtttctaaagagaattctactgttgatgaaacagttagtgatttattttctgatggaaatagtaataactctagttctaaaaccgagtcagtggtaagtgaccctaaacaagtccccaaagcaaaaccagaggttacacaagaagcaagcaattctagtaatgatgctagcaaagtagaagtaccaaaacaggatacagcttcaaaaaaggaaactctagaaacatcaacttgggaggcaaaagatttcgtaactagaggggatactttagtaggtttttcaaaatctggaattaataagttatctcaaacatcacacttggttttaccaagtcatgcagcagatggaactcaattgacacaagtagctagctttgcttttactccagataaaaagacggccattgcagaatatacaagtaggctaggagaaaatgggaaaccgagtcgtttagatattgatcagaaggaaattattgatgagggagaaatatttaatgcttaccagttgactaagcttactattccaaatggttataagtctattggtcaagatgcttttgtggacaataagaatattgctgaggttaaccttcctgagagtctcgagactatttcagactatgcttttgctcacatgtctttaaaacaagtaaagttaccagataacctaaaggtcattggagaattagctttttttgataatcagattggtggtaagctttacttgccacgtcacttgataaaattagcagaacgcgctttcaaatctaatcgtattcaaacagttgaatttttgggaagtaagcttaaggttataggagaagcaagttttcaagataataatctgaggaatgttatgcttccggatggacttgaaaaaatagaatcagaagcttttacaggaaatccaggagatgaacattacaacaatcaggttgtattgcgcacaaggacaggccaaaatccacatcaacttgcgactgagaatacttacgtcaatccggacaaatcattgtggcgtgcaacacctgatatggattataccaaatggttagaggaagattttacctatcaaaaaaatagtgttacaggtttttcaaataaaggcttacaaaaggtaagacgtaataaaaacttagaaattccaaaacaacacaatggtattactattactgaaattggtgataacgcttttcgcaatgttgattttcaaagtaaaactttacgtaaatatgatttggaagaaataaagctcccctcaactattcggaaaataggtgcttttgcttttcaatctaataacttgaaatcctttgaagcaagtgaagatttagaagagattaaagagggagcctttatgaataatcgtattggaactctagacttgaaagacaaacttatcaaaataggtgatgctgctttccatattaatcatatttatgccattgttcttccagaatctgtacaagaaataggacgttcagcttttcgacaaaatggtgcgcttcaccttatgtttatcggaaataaggttaaaacaattggtgaaatggcttttttatccaataaactggaaagtgtaaatctctctgagcaaaaacaattaaagacaattgaggtccaagctttttcggataatgcccttagtgaagtagtcttaccgccaaatttacagactattcgtgaagaggctttcaaaaggaatcatttgaaagaagtgaagggttcatctacattatctcagattacttttaatgcttttgatcaaaatgatggggacaaacgctttggtaagaaagtggttgttaggacacataataattctcatatgttagcagatggtgagcgttttatcattgatccagataagctatcttctacaatggtagaccttgaaaaggttttaaaaataatcgaaggtttagattactctacattacgtcagactactcaaactcagtttagagaaatgactactgcaggtaaagcgttgttatcaaaatctaacctccgacaaggagaaaaacaaaaattccttcaagaagcacaatttttccttggtcgcgttgatttggataaagccatagctaaagctgagaaggctttagtgaccaagaaggcaacaaagaatggtcatttgcttgagaggagtattaacaaagcggtattagcttataataatagtgctattaaaaaagctaatgttaagcgcttggaaaaagagttagacttgctgacggatttagtcgagggaaaaggaccattagcgcaagctacaatggtacaaggagtttatttattaaagacgcctttaccattgccagaatattatatcggattgaacgtttattttgacaagtctggaaaattgatttatgcacttgatatgagtgatactattggcgagggacaaaaagatgcatatggtaatcctatattaaatgttgacgaggataatgaaggttatcataccttggcagttgccactttagctgattatgaaggtctttatattaaagatattttaaatagttcccttgataagattaaagcaatacgccagattcctttggcaaaatatcatagattaggaattttccaagctattcgaaatgcagcggcagaagcagaccgattgcttcctaagacacctaaggggtacctaaatgaagtcccaaattatcgtaaaaaacaagtggagaaaaatttaaaaccagttgattataaaacgccgatttttaataaggctttacctaatgaaaaggtagacggtgatagagcggctaaaggtcataatataaatgcggagactaataattctgtagctgtaacaccaataaggtccgagcagcaattacataagtcacagtctgatgtaaatttacctcaaacaagttctaaaaataattttatatacgagattctaggatacgttagtttatgtttgcttttcctagtaactgctgggaaaaaaggaaaacgagcaagaaaataaggagaaattaatatgattacacaagaaatgaaagagattattaatagtcagttagcaatggtcgcgacggttgatgctaaaggtcaacccaatattggcccaaaacgttctatgcgtctctgggatgataaaacgtttatttataatgaaaatacagatggtcaaactcgtattaacattgaagataatgggaaaattgaaattgcctttgttgatcgtgaacgtcttttaggttacaggtttgtgggaactgctgaaattcaaacagaaggtacttattacgaagcagcgaaaaaatgggcagaaggacgcatgggggttccgaaagcagttggtattattcatgtcgagcgtatttttaatttacaatctggtgctaatgcaggtaaagaaatcacttaatataaaaaagcctcaagaaggggcttttttatattaagcaatactagattaagtttgttttcgagttattagtaatatctgcgatagcaagccaaatttccatttgataatcagtatcttgtggatgttgagatgaataaatttctaagtttggcgagttagctggttttagattattctcttgaaaaaatccttgtattatttttcgccatgtttcttgaagactcgatggcattggacctttaacagaaatgactgcataggtagcgcttgggatcctaataatttctaacccttttggggcttggacacttgtctctacttgataagtggcactgtaatcgaaacgaaaatcaggttgtgttttacaaatgccaatggcttgctggataccttcttgatttgactttacattttctaaagttactccagcaagtatcattgctggcttttcaacaatttgaaatgatagcataaaaatctttattctttatgattccttaagtaattatagagtcgttaaaatagtttctttttagaataattgtcttgttagcaatcataattttcttttggaatgatatggttcaaagaagaaatcttatgatatagagtattctctaagaggcacttattttatagcttttttctaaaaaaaatctattgactatttttgtttatttctctaaagatgatggattaatctttattctttaataacgccatggtgtctcataagggtaccaacgatttgctgaatgagatgctaatctagaaaatggataaacttctttaccctcttttttcaacatatcttctagataatctctcagcatacaaacatctccaggataagtaacatcaagacttaaaagagattcaacttcactgatattaagttgcaagtctttagcaacttgtttaataggataatttaaccttctaaaattttcttgtaattcaaaggttgtatctttcatttcttgaatagtaagcatatcattctcctaatagttggtttaataattggttgatctttctttttggcttttgggaaagtatctctcttgctatgtctgttattttatatccaaatttccttagctttattaaaggctgaccaagcttttggccatccaacataaaaagcgaggtgagtgataatgtcagcaatttcttctttagtaactccgttttgtttggcaaattgaagatgatgctctaactgttcaagatttcctccgctaattaaggcagatatagtaataatagaacgtgttttatctgttaaatgatcctcttttgcccaaacctcaccaaataaaatatcatcattatatctggcaaattcaggtgcaaattcttctaattgacgacgtccggctgtttgtttttctttcataatggattcctccttacttgaatttaacctagtcttgaatattcttcatcactaacagcttcataaaactcactcttaccagctgtaatcgcaatatgtgcaaattcagaatcttttttagcaccatgccaatgtctaacacctttatctgtaacgataacgtcgcctggttttaatgacactgcttcttttccttcttcttggtaccaacctgaaccttctgtaacgagaaggatttgataaccgtccaaatgaacatgccaattattacgacagcctgcttcaaaggttacatttccaactgaaacattcccatctggagattttgctaatgctgcgagataggattgcccaataaagaattcaccatatggatttttttcacccttaggaaagatagacttagttgtttcttgcataagatttcctcatttcgttgttggatcaaaaagttcttgttctctaggaacaactttattttgataattgtctattttgtgatttagacgattaagtgcttcttggaggccttgaagcctatcttcaagattgtcgcgttcatcttttaaaatttctagcctagctgggatagtggaatcgcctttttcaaccaaatgaatataatcaatgagactttcaacggaaacacctgcgcctctaaaatagcggacaaattctaaaatatcaatatcgttttgtgtgaactcacgaattcctgattcactccgatgaatagggggaataagattaattctctcataatacctgatggtatctgacgtaatgccagtctttttactaacttctttgatatgcatttttaacctcgatattcagtcaacaatcactaaggatttgatagcgtcacgtttatccattgcttcataagccttttgaatatcatctaatacaaaggattttgtaaaaactaagcctgggttaattttatgagttagaacagcatctaaaaggacagacttatcaaatgttgttacagaagcaatgccacctctaaggccgatatttttccagaataaattattggtattcatgtctggattttgtgggataccaacacgtcctatgacagcaccaggcctagcaatttgggtagctgtatcaacagactgctctgtaccaacacattctaaaacagcatcggcacctgcttgattggttaaatctaaaacacgtttaacggcttcgtcaccccgttcttcgacaatatccgttgcaccaaaagtcaatgctagttcctgcctatctttgtgacgactcattgcaatgatacggttagcacctaacattttagcagcgataacaccacagagtccaacagcaccatctcccatgacaactaccgtgtcaccttctttaacttctgcagttgctgcagcatgataaccagttgccattacatctgataaggtgagcagagagttaagagtctcattatcataatcagaaggttgtcctgggatcttaaccaatgcccagtttgcattagtataacgtagatattgaccttggtatcctacattttttgcagcttgatgatttgtacaatttccatcaaatccagccttacaagacggacattggccacagccatgtgtaaagggaacaataacaaaatcaccttttgacacgtcagttactttagtaccaacttcctcaacgataccaatagcctcatgacctgcaaaagaaccactttcacgttttgaaataccacgataccaccacaagtctgaaccacaaacacaggctctaacaattttgataacagcatctgtctcttgttcaatgactggttttggtgtatcagttataaccattttgccaggttcaataaatgtagctactttcataaccttacctcttttctataacttcattataactcttagagttaacttcaagtcaagaaaaacttaaaaattttgaaaattaaacatctgtaaaaatccgcatatggtttcattttccactaaaaacagggaagttagaaaattccccataatcgtcaaacataagtgattttaatatcgacatatcttcgtcactaattacaaagtcaaagtctagattagactgtaaatgttctttactagaagcctttggtaaaacgatcaggtttaattgtagtaaatattgaatacataattgagcaacactaaccccatatttttcagccattttttgaataccatcagatttcaatgcttgtccatgtgcaattggtgaataggcttcaacttgaatacctttactttgacagtaatcaatcaagtcgaaaggtgtatttccgatgtgagctaagatttgattgacagcaggtttaacatgaccattttttaagatattttctaagtctttttctaaaaagtttgagacaccgatggatttcatcttaccagatttttgagcatcctctaaagctctccaagcttctaaatttccttggtcaaaatgtttatctgtttcacgccattccttccaaggctgtggactatgaataatcattaaatcaatataatcaagccctaaagcttctagtgattgatcaattgattttgtagcactttcataatctttatgttcagcggcaattttagtcgtaacaaataaagattcacgtgtaataccagactctttaatccctacaccgacacctttttcattgttgtatgcttgtgcagtatcaatatggcggtagcctaattcgatagcatctttaacaacttgagctaccctatcattatctatcatccacgtacctaaacctaaagttggtattttatgattgtcatttaatatcattgtatctgtcatctttattttccttctttcattagtattgacctaatcttaacacttagagttaactccaagtcaaggaaaaaactaacactcaggttagttttttaatggtttgcaatgattttgatgttctcttaaagaataatcgatttcaacagtaacatcgtttatcttataatgttggcaaatcgttcgaatagctcttttacaatctttttcagatatcaattgatttaagcaacagtgaatgattgctcgattatcaataccatccattgaccagatattgagttgattgatagatcttacttgcgaaagtcccttaagttcatcatgtaatgcagcgtaatctatggaatctggaacaccatctaaaaaaagtttcagggttgatagtaatttaggaagtgctttagataagatgaaagtagatatggcaactgataataatggatcaaggatatacaacggtttccaatttaagataagagatataacaataatagctaaccaccctagaatatcttccaaaaaatgaaggcttaatatttcctcatgtttactttgaccagaatggagaataaaactagctagaccattaatgataatagcgatgacagctagaataaacatgccgtgataattaacaggagtaggatgccacaattttgggatattttctatcatgactaagatagatccacttataagaattagacttgtgataagagctcctaaaaggctaaaacgtttataacctaatgaaaatatcgtatcttcatctttcttagattttttttctaaagtagctgagatgccaatagctattgcatcaccaaaatcatgaacagcatcggctaagatagctcctgagaagaatagacttccaaagatgaattcaaggacggaaaagctgatatttaatataaaagcgatagccacttttttgtttgatgtcatatttttctccttttgttatactggtattgtagtgtgattctttcttctattatctaggagataaaagagaattgctagaaacaaaaaagaacacttgttcaatactgaacaaaacttagaaagtgtcctatatggtaaaagatagacaaattcagaaaacaaaagtagcgatttataatgcttttataagcttgctacaggaaaatgattattctaaaataacggttcaagatgtaatcggacttgcaaatgtaggaagatcaactttttactctcactatgaaagcaaagaagtgttactcaaggagctctgtgaagacctttttcaccacttatttaagcagggtagagatgttacgtttgaagagtatttagttcatatcttaaaacattttgaacaaaatcaagatagtatcgctacgttattattatctgacgatccctattttttattacgctttagaagtgaattagaacacgatgtttaccctagattgcgtgaggagtatattacaaaggtggacattcctgaagatttcttaaaacaatttcttttatccagttttatcgagaccttaaagtggtggcttcatcaaagacagaaaatgactgttgaagatttactaaaatattatttaactatggtagagaggtaaattatagagagttgggagattctcttatttcattagcgttatcagaggtgatgaatggattgattgtctaatatagcgagttgaaattattagattaaatgagtataattcgggagataaaaaagtccccttgatgaaagagtttctttgggattgttgatgtcaccataagcaaaatgaatatttttcgattactatattgtcttaggcttttgcttatattctagtgggctaattcccactatttttttaaatgtccttgaaaaattagaagaagtggaaaatccaagtaaattggaaacttcttctactttcttattttcatctagtaattgcttagcagcttcgatttttaagtttagaaaatattgttgaatagtgatgtgtttttcttgcttaaatagttttcgtaacttcgattcactcatgtgacattctttagctatttcttctgttttaataaagcgatttagattattttcaagatatcgaatcactgcgacaatagtttgagaatgaggggtttcgagatgtttttttaaagaatgaacttgttgagtatagaataagatagcagtatcacgtaattttaaaacttcatttagacttatagttgactcgttttcttttataaaacgatctcgtgctcgataagctgtttcgatatcaagtcctgcttggatggtagcctgtgagagacgatcataaatcatgatggagtagtttttttcagatcgcaattcatctccactgattataggtacgatagaattgctaaattgttccactgtttctttcaaaagaaattcactacctgatttaacagcttttagaatattattttcaaaatgatactgatatttgtaagaactcatattctgtttagaaaattgcttaattttatctagatcaaaggagttgctccaccctttcgtgtagtaatgtaagggctctgataatttatctttcacaaccccagttagacaataattggttactattagtaattctcggatttgactaagtgagaagaaaggtaattgggatagtctatcaataaagtagtcttgttcactagcattgatttgtgtttcagtcagctttttcttaagaagtaaagggtcaataacattgctacgccagggaccgatgataatataatattgttgaatatggtggacaagaaaaagttctcctaaagagccataatgaaataaaaaatcatgttgagttttactaaagttacttaaaataaggtaatgattgtaaaaaagtgaaatagttttctcggatttatactctctgataacagaaaaattttgatcacaaacagtaatagttagacctagaagactgtgtaatgatttcaacagtagaaaatcaatcatatgagttaccacctttgatttaatatgttatctattttagagaatatttctttaaagtcaacagaataattaggtagtcgatacctttttaaccaaatatgaattaaaaaaccgaaaaagtcaaatcagaaaaaaaaaaaaaaacagattagatcggataaaaaagtatagatattctaatatttgtttttaaagcctatactttactatgtatagagctatacagaataaagtaaaggagaatattatgtttagaaggtctaaaaataacagttatgatactttacagacgaaacaacggttttcaattaagaagtttaagtttggtgcagcttctgtactaattggtattagttttttaggaggttttactcaagggcaatttaatatttctacagatactgtgtttgcagctgaagtaatttcaggaagtgctgttacgttaaacacaaatatgactaaaaatgttcagaatggtagagcatatatagatttatatgatgtgaaaaatgggaaaatagatccattacaattaattacgttaaattcacctgatttaaaagctcagtatgtcattaggcaaggcggcaattatttcacacaaccttctgaattgactactgttggtgcagctagtattaattatacagtattgaagacagatggaagtcctcatacgaagcctgatggacaagtggatattgtaaacgtttcattgactatttacaattcttcagctttgagagataaaatagatgaagttaaaaagaaagcggaagaccctaaatgggacgagggaagtcgcgataaagttttgataagtttagatgatatcaaaacagatattgataataatcctaagacgcaatcagacattgccaataaaataactgaagttactaatttagaaaaaatactagtacctcgaatcccagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatggtaaaggaaataaactaccagcaacaggtgagaatgcaactccattctttaatgttgtagctttgacaattatgtcatcagttggtttattatctgtttctaagaaaaaagaggattaatcttttgacctaaaatgtcactaaacttttcaccatttattggtgtgaacacattaataaagttatgtatctctcttcaacaaacttaattaaagtgtttcaatttttcgagtttaattcttgaaaaatcctatcgagattattaatttcgataggattttgattttgtgtaagcgtccaataacgaggtatcttccattttcttccctattccgtaagcatccaatataccttgttattggacgcttactataaaactgaagaaatgatcctatttagttgaaatttgtaaatgaagtgtatcattagagcctaagatgttaatcctaggctctcttttgatgatttaaaatttttaggtgtaatcaaatgtaaggttagatgcaaaattttctaaaatgactgtttgtcttttcaagtaattaaatgtatttaagggtaatttataaaaataaaaggagtgtgtcaataatgttgtgtaaacacactggcaaagctgggattgttaatcaaataggctttcaagtgtgtctgtacattggccaaaacctttgtggattcgttgttcttgcttgaagttgtaatcattaaatagtgtgactagatagtattctagagcctcttcattgggaaagacgatttccttttttgtttgcgttgtattgcatttagtgatacaatagttatacaaaaatgatttgaggtgatattatgtcaacagtagcagtaagagttgatgatcaattaaaagatgatgctacagaactttttcaatccttagggttggatatgagcacagcagtaaaaatgtttttgattcaatctgttaaaactcaaagtattccttttgaaataaaaaataaatcatctgtttctgatgaagaatttcaaaatttggtagaaacaaaattaaagggaatacgagttaaggctagtgatccagaaagtgtaaatgcgttttttggagatgaagatttttcagaatatgaggaatattttaaatgagtgatattgaggtatattctgtattagtttctcgtattgaatattctgatggtacaggttcaaaggttcgtcctgctgtagtagtcaaatttaatgatgaagtaataaaaactttaagatttactactaaatatgaaaataagtctgacaatataagaagtcagtatttagaagttattgattaggcaaaagcaaatttaaataggcgttcttggatagatactattcaatattatgatgttgagaataaagggttcaatattaaaattataggtaagttaagcgatagagatgttgagaggttaaaagattttctcatagcaaaggaagtttagttatgaaaaagaaattattaggattgatgattttagctatatctacagtatttttagttgcttgttcgactaattcgttaaatgtaaagtattataaagtatatgatggtgaaaaaatgttagttttagaaattaatgatgaatcaggaatttatcataatgaaggaaactttgtagtaactaatattgatactaaaagtaaaagttttgtacttaaaggtgggtctgctaagtatactgttttatatgatgttaaaagtgatggtaaattgaatgttgatttagggaacttttattataatgcttctggtaaggagacatattataaagaaggtagcaaggctttagaaaaagcattaagagataaagaataaagttaggactattttcctaacttatttttttatttaaaaaatgaacttcaaaatgcaaagtcttaattttacttagcacctaatttttagttaaataatttgtatcccagcaataaaaagtatttttaccgaaatcaaagtaagaaccaaaaagaagatggggttactctgtcttagtttttcttggaaagtgttatctgttaattcaatgaaatcaagcgaggaaatgagatagcttttatttaattgatgagttgctttttccagattatttggagttatttgctcgtattcagaaataatattatgttatgatatcataaagagctaaattcatggtttgatttttatttctttgaaagttactaacgatcgtacttatttctttattgttcaaattggaataatctttaagtagatggaaaagtcgtatttctaaacattcctttgaaatttctaaatcaatggttatttctttgaatagtttattttcgtaaacaattttatagagtaacttgggatgatattgattttgaaagaaatagtatttatacatatcgaagatattcttcaataaaaaatgactttacaaagcctaaaacaaggacttcaataaggagagtttcagtaagtcatgatttaaaagagttattgcttgaactaaaatttcaacaagaaagaatgctgaaaggtttgcatataaaaaatacagatcaattgattttttatgactataggtttggtatgatatcaaatgatgctgttaacaaattcttggcaagctcattggaaaaattagaaatagaatctaagatgtcatcaacaggtgctagacatacttatggaagttatttgttggctaacggagtagatatttgggcggttgcaaaattaatggggcataaagatatcaaacaattaatagaaacatatggtcatttgcttctgtaagtggaagaaaaggaaaatgatcagcttttaaaaattcttaataataaaggtagtttttaaaatgactatcaagaacaaattaagaacaaaaataaaagaaaccctattataataaggtttcactcatatattttctgccaccaccgagaattgaactcggaattgagcattaccattgctctattataccatttaactatagcggctacttttctatgatactataagattttgacgaaatcaagtatttctttacttagaaaaatagtcgtttttttagtctaattctatttggagaaatttactattttcaatagctcttaaatggtgtgtttcttgtggagagaggctaataaggctatctttttcaaggatatgtttctgatcaccaaggataatttcaagttttctttccaaaacatttattaattttggatgagggcatcgttcatttttcagtccccggctgatgattttaatggtattgaataaaccttcatctttaatcattcctaacggggacataagacttatttttccaaattgatattctgaactttaaaaaccattttgtaagaataaattttgccaatcatctatttttagaggagcaacgttaacattcatagtatgtctaagttgatcgatcagcttggcagtgtcttcatcttgataagaaacatcatgtgtgagtaaacgtccaccaggttttaggacacgtaagtactcttttatggctttctccttagctgaattgttaagcatcgttaacattgcttcgttgataacgataaactattatcaggaaagggcagtctgagtgcatttccctgaataacttcaataaattcttctaattgggcctttttgacattttctttggccttttctattactttactatctagatcaagcgctgtaatgtgacaggaaaatgctttagcgatatcgatggaactggtacattgattacaagctacttctagaacacgactgtcagcactaaagtgtccttttttgataagccaattcgttgcttggacacctcctggtcttaagcgttttttcctagtcgtgctaagaattgatgtccaatttctttatgtggcaataagatcacctctttcttttaatagtaatatcattttttcttaattataacacatagatgctaagataacaaggagtaatagtgattgaatggtataagtgatgaattttagagagcgttttcttttaactaggggtgtgatgccaaaactagaatggcatagagaaccatacatctcaaaaggtcttccttagataaaactagttgtttttatatctgtcagaaaaatcataatttatttttgatataatgattttttgagtatttaatttatatgttataatgaaaaaaactaaaaaagaggaatatcatgtcatacgaacaagaatttttaaaagactttgaagagtggttacaatcgcaaataagtatcaaccaaatggcaatggacagtgcaaagaaagttttagaggaagataaggatgagcgagcagcagatgcgtatattcgttatgagagtaagttagacgcttatcgctttttgcaagggaaatttaataactatcataaccaaaaatctttccatgatttgcctgatggtctttttggacaacgtcattattaaaaggtttatcgctagaaagcttgtcaaataggcatttctatgatacattgttatagtagtttttagatactatgatagatttcataaatgaggagaaagcattatacaatggcaaagcgtattaaaccgaataaaaaaagagagcttttgaaagctaaagggatcaattggaaggatgttcgactatctcaaactttacaagaagtcgcattaccgaaaaagacggctcctgaagcgccaaaggcagtcgatcttttagaaggtttaactgctaataaacaagatgttttaaaagaagctggccttgtcagccttgaagcatttgcgaaagtaagtgaagcagatgttttagcactaaaaggtattggtccagcagctattaaacagttagttgataatggtgttgtttttgcaaaataatttgatttaccttgcgaaagtagccttattttgctagaataaattaacttagaggtgttttgaaatcccatttgtcacaggaagcggtcatactgagaaatccgcacaaatgtcaaagcttgttgctaagtccaataattgaaacaaaacgagttgcggatgttatcatccgaatttgggtggtaccgcggaaatcgtaacacgaaattcgtccctgtcagaattgacagggattttttgtatttaggagtgaggagattgaagtatatgcagattctagaagatttcgatggcaaagcattaccaaaactagaaacggatcggcttatcttgcgtcagcgaacggtgggggatgtcccagccatgtttgattacgtttgcttggaagaggttgcctatccagcaggactcagcccaatagcttctttagaagatgagtacgattattttgaaaatcgctactatcaaaatctggaaaaggcaaaattaccatctggttatggtattaccgttaaaggaagtgatcgtattatcggatcctgcgcctttaaccatcgccatgaagacgatgttttcgagatttgctatctgcttcatcctgactactggggtcatggctatatgacagaagctgtcgccgctttgattgaagtcggttttacccttctcaatctccacaaaatcgaaatccgctgctatgattacaataagcaaagccggcgcgtggcagaaaaactaggattcacccttgaagctaccattcgtgatcgtaaggataatcaagacaatcgctgtgtcaatttgatatatggtttgctgaggagtgagtgggagtaattattctactcttcatagaagttactagatcgactaatttggctgtgcagggcacttaactaagtcatcaataatatcgtagatatggaggagacaaatgattaagatacttggagaaatcgtagataaccagctacctgttgtggaaacgaatcgtctgttgttgcgtcaacgcaagttagaagatgctaaggagatatttgaatttgtcaaacttgatgaggtgagttatccagcaggttttccggctgttaaaagcttggaagaagagataacctatattcaagagatttatccaactaatcttgaaaaagaaaagttaccctctggttatgctattactctaaaaggcgatgataaggtaattggttcagtagattttaaccatcgccacgaagatgacatttttgaaattggctacctgctccaccctgattattggggacaaggcattgtgccagaagcagcttcagcccttgtggagataggtttcacactgctaggactacataagattgagctgggatgctatgactataataagcaaagtcaggcggttgcgcgcaaattaggttttactttagaggctaatattcgtgatcgaagagatgcccaggggaaacgttgtggcgatatgcgctttggtttactgcgaagcgagtgggagaaaaaaagaagatgaatattattatcatcggagcacaagcttctgggaaaatgacaattggtcaggaaatcgcaaaacagacaggcatgaccttattccataaccatgattctatagattttgttttacgcttcatgccatggtctccagatagtattgctctaacggagtctattcgctttaaattttttgaaacgtttgctaagactggtcaagaaatgatttttactattgtaattgatttcaatgattcaagagatgtagtatttctagaaaagattcaaatagtttttcaatctcacaaccaagaggtattatttgtagaattagaaacagagctaagtgagcgtctcaaacgaaatcgcacagaaaatcgcctcaagcataagccttcaaaacgtgatatcaaatggtcagagagcgatatttgttcaaccatggattacgctatctttaatcctgaagtagccccagaagcgcttacatattatcataaaatcaataatacttgcttaactgctactgaaacagcatatcttattattcaaaaaataaaccaaatcaaggagaaaaactaatgtcaaaagaactatcaccaaaatacaatcctgccgaggttgaggaaggccgttatcaaacttggcttgaccaagatgttttcaagccatcaggggatactgaggctaagccttattctatcgtaattccaccaccaaacgttacgggtaaattgcacttgggtcacgcttgggatacaactctacaagatatcattattcgtcaaaagcgtatgcagggctttgatacactctggcttccaggtatggaccacgctggtatagccactcaagctaaggttgaggagcgccttcgtgagcaaggcatttcacgttatgatcttggtcgtgaaaaattcctagataaagtttgggaatggaaagacgagtatgcagcaactattaaatctcagtggggaaaaatgggtctttcggttgattatagccgtgagcgttttacccttgatgagggactttcaaaagcggtaagaaaagtctttgttgatttgtacaataaaggttggatctatcgtggggagttcatcattaactgggatccagcagctcgcacagccctttcagatattgaagttattcacaaggatgttgagggtgctttctatcatatgaattatatgctggaagatggctcacgcgccctagaagtagcaacaactcgtcctgagactatgtttggagatgtggctgtagcggtaaatccagaagatgcacgttacaaggatttgattggtcaaaatgttatccttcctatcatcaataaacctattccaatcgtcgctgatgaacacgctgatccagaatttggaacaggtgtggttaagattacgccggctcacgaccctaatgactttgctgtaggtcaacgccacaacttaccacaagttaacgttatgaacgatgatggtactatgaatgaacttgcggatgaatttaatggtatggatcgtttcgaagctcgtaaggcagtagtcgctaaattagaatcgttaggaaacttagtaaaaattaaaaaaacgactcattctgttggtcattcagaacgaacaggcgttgtggttgaaccacgtttatctactcaatggttcgtcaagatggatcaattggctaagaatgccattgccaaccaagatacagaagacaaggtagagttttatccaccacgatttaacgatacttttatgagctggatggaaaatgtccatgactgggttatctctcgtcaattatggtggggacaccaaattcctgcatggtacaacgtcaatggtgagatgtatgttggagaagatgccccagagggtgacggatggacacaggatgaagacgttctagacacatggtttagttctgctttatggccgttttcaacaatgggatggccagacaccgaagcagctgacttcaaacgctacttcccaacgtcaaccttggtaactggatacgatatcatcttcttctgggtatcgcgcatgattttccaatcccttgaatttacaggacgccaaccattctcaaatgttcttattcatggactcatccgtgatgaagaaggacgtaaaatgtctaaatcactcggcaacgggattgatccgatggatgtcattgagaaatatggtgcggatgcccttcgttggttcctctcaaatggttcagcccctggtcaagatgtgcgtttttcatacgaaaaaatggatgcttcgtggaatttcattaataagatttggaacatttcacgctatatccttatgaataacgaaggtttaacgttggatcaagccagagaaaatgtggaaaaagttgttaatagtcaagttggaaatgtaacagaccgttggattctccacaatttaaatgagactgtgggtaaagttactgaaaactttgacaagtttgaatttggtgttgctggtcacatcctttacaactttatctgggaagaatttgctaattggtacgttgagttaacaaaagaggttctttatagtgacaatgaagacgagaaagtcatcactcgctctgttcttctttataccttagatcaaatcttgcgtcttcttcatccaatcatgccatttgtgacagaagaaatttttggacaatatgcagaaggatcaattgtccttgcaagttatccacaagttaacgcgacatttgaaaatcaaacagctcacaaaggcgttgaaagcttgaaagatttgattcgttcagtgcgaaatagcagagcagaggtcaatgttgctccatctaaaccaatcactatcttggttaagacaagtgacagcgaactcgaaagcttcttcaaagacaatagcaactacatcaaacgcttcacaaacccagagacgcttgaaatcagctcagcaattgccacaccagaacttgccatgtcatcagtcatcacaggtgcagaaattttcctcccacttgctgacctccttaacgttgaagaagagttggcacgacttgaaaaagaacttgctaaatggcaaaaagaactagatatggttggcaaaaaactcagcaacgagcgctttgtagctaacgctaaaccagaagtcgtccaaaaagaaaaagataaacagaccgactaccaaactaaatacgacgcaaccatagcacgtattgaagaaatgaagaagttggtgaggtaaaaaaataaaaaaacgctatcataaatgatggcgttttttgatataatttgattatggatctttagagataataagtagaaattgtgcagccttattatgtatagtcgctttaaactgtttgatgctagttcttatgctataataactctatcaatgtcaaaggagtttttatgtcaaaggtaaggtatggtgttgtgtcaacggcaaaggtggcgcctcgttttattgaaggagtccgcttagcaggaaatggtgaagttgtggctgtatcgagtcgaactcttgagtctgcgcaagcttttgccaacaaatatcatctcccaaaggcttacgataagttagaggatatgttagcagatgagtcaattgatgtgatttatgtggcaacaattaatcaagaccattataaagttgctaaagcagctctgttagcgggaaaacatgtgttggtagaaaagcctttcacattgacttacgaccaagcgaatgaattattcgctttggcagaaagttgtaatctgtttttgatggaggcacaaaaatcggtatttattccgatgacacaagtgattaaaaaattacttgcctctggtgaaataggagaagtgatctccatctcatctacaacagcctacccaaacattgaccatgtaacatggtttagagaacttgagttaggtggaggaacagtgcattttatggcgccctacgccctgtcttatttacaatatctatttgatgcgactataactcatgctagtgggactgcgacttttccaaaaggtcaaagcgatagtcaatccaaactactcttgcaattatcaaatggggtcctcgtagatatcttcttgacaacacgtctaaatttaccgcatgaaatgattatttatggaactgaaggtcgtctaatcattccacatttttggaaaaccactcatgcaaaattggtgagaaatgatactagtgcgcgaacgattcaagttgacatggttagtgattttgagaaagaagcttatcatgttagtcaaatgattttagaagggcaaagggtaagtcatatcatgacgcctcagttgacgctgtcaggtgttaagattatagaagacttataccgttcatgggggaaatgatgctggctatctagcatattaataaggagtactagatgttattttagtagtccttttttgttttgctctcataaggttaattagatttaaaagggttttctacttgttttttctcgatttttatttcataatgtagacaagtttagagtgaggtgcttctatgttttcgagcgattttggatttgagataattaatgttgacgacctatccttgcaagaggagagatttttaccttcagaattgctggcttatgcacgtgatgaaaatgagtcttctttcgtacgtgatattgaggggcatttggcacttgtttaccagcttttggatacgcaaggtcacgttgatgatgttcgtcatgtgccgagagtgataccagtgactctatttttgaaagaagatggcttgtttgtattagctaatcataaaaatattaaccttgtaaaaaaagcacttaatcgtgttgaaaaggtagattctccgaaacacctcttattatcattagtgactgctttctcaaagcaatattttgatgttttagatactatttctgaagaaagagataaactaatcaatgatttgcgtaaaagaccaaacaaatcgaacttggcaaggctggcaaatttacaaagtggaacagtacacttaatgatgggaactaagcaaaattttgaaatgctgaccgatttacaaaacattgagcaagataaagagaacactagaaatgaaaagatgcaacttcaagatgctattattgaagcaagacaattatctaacatgtgttccttaaattcacaggttttccaagaactttcttcttataataatgtcctcagcaataaccttaacgacaatgtaactactttaacaattatttccattggtatttccattattgctatggttaccagtttttatggaatgaatgttaagttgccttttgatagtgtggatgctgtctgggtattgattattttaattacgactatcattactattatgctctctattgttatgtacatttagagtctgtcaataatcttgtgtaaacactctagcaaagctgatattgttaatcaaataggctttcaagtgtgtccgtacattggccaaaacctttgtggattcgttgtccttgcttgaagttgtaatcactaaatagtgtgacgagatagcgttctagggattcttcattgggaaagacgactttctttttggtttgacgtttgatttctttgttaagtgattcaataaggttggtcgagtagatacttccccagatctgatgaggaaattcataaaagatcaatagattttcgattgattctaaggtctctattaccttcttgtagtgtggtttccactcattgataaagctatctaaggcttgctttgcttcctctacattgatcgcgcgataaattgttttaaactgctccaaaattagagcacgatctgctcgtttcaccttacttgcaatatttcggccaatatggacaaggcaacgctgttgtttggccattgggaaggcttgctggataagctgatcaagtccattaaaaccatcactcacaacaagagagacttgttgtacaccttgacccttaaatctttctagaaggtctgaccacgaagcattgttttcattgggtgcgatgtcatatccaaggatagccttatgcccatatgatgtgacgcctagtgcaatgtggatgcattccttactaactgtaccacgtctcagaggaaggtaagtcccatcaagatataatacggtatagttagcttctaaggaacgttcatgaaagctagccacgttttcctgtgtcgctttcgagatattagatactgttgctggactgtaatgatgaccatacatacgctcaatgatgtcgctgatttcacgtgttgtgactccagttcgataaagcttgataaccatttcttctaaatgattgtctcgacgaccgtaacttgggattaaggctggactgaactccccgtttcgatctctagggatcaacaaattaacaacaccatacttggtctcaaatcgacgtgtataagcaccattacgactattaccggtgttgtaacctgccttatcgtatggttcatagccaaggaaggcggatagctccacttggagaaggtcattcatggcagtttcaagagacgaacggaaaaattcatcaatatcttgtttttgagctaggaagttaagtaattctgtggtaaactgggtcatgggaataaatctctttctagtgaagtctcgcaactctactatacaggatttattcctttttgtgtttacacaagatattttacactacctacatttatgtccataaagaggataatcatcccaaacataaatagagaattaataagagggtactatcaattagtttagttttaagcatggtaacatgctttttttgtacgaagaaactttagcgcaaggcagaattcatctttgactttgagcttgctttctagctcttaaaacgacataatagaggataatgtacagtgaatagagaggttactatgtcaatagaatcagattttttccggaaaaaacgttttattttttcatcgcttgaggagtttggatttatcaaatctgaccaagagtatatctattgtcaaacatttatggataatgactttaaagctattatcacgatttcattggatggaaagatagctggtaaggttattgattcggcacttgaagaagaatatttaccgcttcgagcagcaaattataatggttcgtttgttggcgaagtacgatcggcttatatggctatattaggtgatatttcagattcttgttgtaaggacttattatttaccaaagatcaaagtaatcgtttagcggagaagatagctaaaacttttgaagattcagttgattatccatttgcgaagcacccacaatatgcttcctatcgtgtgtcaggtaaatggtatgctctgctttttccattgaagatggggaaactagaaaatgttccagctcaactgtcagaagatgaggttgaagttttgaatattaaagtcaatcctcaagatatggaaatacttttacaaaaagaaggtatttatccttcttatcatatgtctaaaaagacttgggtatctatcgttttagacaatactttgtctgatatagaaatttttaaattggtatcagatagtcgtaagcttgtttctcacaataaaaaatcaaattctgagccagagttttggattattcctgctaatcctaaattttacgatattgataaggagtttgcagagcatcaattgattgattggactcaaaaaggaaagattgcggtgggagattatgtgtttatttatattacagcacctattcgtgcttttcgctatgtctgtcaagtgatagaacgtgaccttaaaacaagtacttacttaggagcaagagatgtcaaagcttatatgcgactcaaactgataaggcaatttgaagattctacctatcctgtagcatttttagcagaacacggcgttaagactgtgagaggaccacggcgaatgaccaaggaattgcgacaagtcatggcaaaaacaattctagagtaatgactttcagaaaaaacttgtaaaaaagtcagaataattctacaattcctcttccattttgttacttgaaggagtataatagctctaacattttataatttaaggaggaacatatgaagaaaagctttattcatcagcaacaggagatttcttttgtcaaaaatacttttacacaatatttgattgataagttagaaatcgtcgaagtgcaaggacctattcttagtcaggtcggggatggtatgcaagataatttatctggtattgaacatcctgtatcggtgaaagtccttaatatacctgaagctgaatttgaagtcgttcactcattggctaaatggaaacgccatactttggcaagatttgggtttaatgagggagaaggtctttttgttcatatgaaagctcttcgtccagatgaagattctcttgatccaacacactcagtttacgtagatcagtgggactgggagaaggtcattcctgatggtagacgtaatttggactatctaaaagaaactgtggaaaaaatctacaaagctatccgcctaacagagcttgccgtggaagctcgttttgatattgaatccattttaccaaagcgtattacctttattcatacagaagaattggtagaaaaatacccagacttaagccctaaagagcgtgaaaatgccatcgctaaggagtatggcgcagtctttttgattggtattggtggagagttagcagatggtaaaccacatgatggtcgtgcaccggactatgatgactggacaacaccatcagaaaatggttttaaaggtctcaatggtgatattttagtgtggaacgaacagcttggaactgcctttgaactatcatcaatgggaattcgagttgatgaagatgctcttaaacgtcaagttgttctcaccggtgatgaagatcgtttagagtttgagtggcataagacgctattacgtggtttcttccctctgactattggtgggggaattggtcaatcacgattagctatgttcttgcttcgtaaaaaacatattggagaagtacagtcaagtgtctggccaaaagaagtcagagatacctttgaaaatatattataaaaaatcagccaagcagttttgtttggctgattttaacaataagtttatttttggcttaagaaagtttggatttgttgaggtgtagcttggcttccttgaacaagatatttagtcatttttccttgttgataatgtgctaaatttggaacagtggtaatatgatgctttttgaaaaaactcttcaatcgtttccctttgtatttttgactatcaaggtagtaaatttttgaatgaagtgtggcttgagattttaataattttggtaagaaagctctacaatattggcaagttggacgtcctataaaaatagtcgcttcagattgttgacttttgcttactaacgccttatctgtgatggcgattaagtcactatttgttatcatgtgttggtattgttgttgagaaatagtcatggtgtcagcgctacttaagtttgattttagcgttgtaaggcataatatggctattaaagttaataatagttttttaatcattatgggaacctcgtttctcttactgctagcttatcatatcaaaaaagaaggaaaagagatactatcttctctgtttgttataagcaattttttgataactctaccttattttttgttataatagtggttatgagagtagtagcaggaacatttggagggcgtcctttaaaaacgcttgatggaaaaacaactcgtccaacaactgataaggttaaaggcgctatttttaatatgattggtcctttttttgaaggtggtcgtgttttagaccttttttctggcagtggtagcttagctattgaggcgatctcaaggggaatggaccaagctgtcctagttgaaaaagataggcgtgcgcaggtcgttattcaagaaaatattgcaatgactaagagtccggagcaatttcaattattaaaaatggaagccaaccgtgctttagaacaattaacgggacaatttgatttggtcttgttggacccgccatatgctaaggaagaaattgtaaagcaaatccaaatcatggatagcaagggtttattaggcgatgatatcatgattgcttgtgaaacggacaaatcagttgatttacctgaagaaattgcttcttttgggatatggaaacagaaaatttatggcatttctaaagtaacggtctacgttcgttaggaggctttggtatggattacaagttagtgatgattattctcatcttagtcatattgatttatttgttgttgcgccttcactatttagaagagttgctaaaacattatcacttcaaaaatgatgaaggagtttgttcattatcaagaacaaaaaatccattgtatctattaatggcaatgattacttttttgccaaatcttatcaattggatagctaatggttttgaggcaatagacattgttcgcctgattcctgtggtagtctttttatggttgtattattgtggagatgacgacgaatgacaaagaaagctttatttacaggttcatttgatcctgttactaatggacatttagatattattgagcgcgccagctatctatttgatcatgtttacattgggttattttataaccttgagaagcaaggttacttttcgattgagtgccgtaaaaaaatgttagaagaagctatccgtcagtttaagaatgtttcagttttagtggcgcaagatagactggctgttgacttagcaagggaagtgggagcaaaatattttgttcgaggtctgcgtaatagccaggattttgattatgaagccaatttggagttttttaataaacagttggcagatgatattgagacagtttatttatcaacgtcgccatctttgagtccgatatcatctagtcgcatccgtgaattgatacattttaaggcttctgtgaagccttttgttccaaagagtgttgttagagaagtggagaaaatgagtgaagaatagagatccaaaaagaaaacataaaagtttactaggtctgcttaaatggtggattataggttttgcttttttattgttagtattagcaagccttgtagtgagactaccttattatttggaaatgccaggtggagcttatgatatccgttcggtattgaaagtgaataaaaaggctgataaagctaagggttcgtacaattttgtagcggtatctgtcagtcaagcaacgccagctcaggttctttatgcttggttaactccttttacagaattatctagtaaagaggagacaacaggtggctttagtaatgacgattatctcagaattaatcaattctacatggagacttctcaaaatgagtccatctatcaagctttaaagttagctaataagcaagtatctcttacttataaaggagtttatgtgcttaacttagctaaaaattcgacatttaaagatagattacatttagctgatacagtcacaggagttaatggcaaaagtttcaaaaattcttctcaacttatcaaatatgttgcagctcttcatctaggtgataaagtaaaggtacaatacacaagtcaaggtaaaaagaaagaatcagttggtaaagttattaaactatcaaacggtaaaaatggtattggtatcggtttgacagaccatacagaagtattatctgatgttcctgtggactttaatactgaaggtgttggaggaccaagtgcaggtttaatgtttactttagcgatttacgaccaattggttaaagaagatttacgtaaaggacgtaagattgcaggtactggtactattgagcaaaatgggcatgttggcgatattggtggagcaggtttgaaagttgtttcagcggctaaaaaaggaatggatattttctttgttcctaataatccgatcgataaaaatgctaaaaaaggcaaaacaaaggttcagacgaattatcaagaggcaaaagcagcagctaagcgattaggtacgaagatgaaaattgtaccagttcaaaatgttcagcaagctattgattatttgaaaaaaacaaaataaactcaaagagttcgggcgtctgctcggcttttttgttttgcgacatttgactatcaaagtgctaaaatgatagtatgacagagcttataagaatactacatttaaatgatctgcactctcattttgagaattttcctaaggtaaaacgattttttcatgacaatcaagcgcagccaatagagacgatttcacttgacttgggggataatattgataaaagccatcctttgacagaagcaagctcgggaaaggctaatgtccaattgatgaatgaactgggtattgagcttgctactattggtaataatgaaggagttggtttatccaaaaaagacttggaccaagtctacaaagattcagattttacggttattgttggcaatctaaaagataacataatcgaaccgagttgggcaaaaccttacattatttatgagacgcagcaaggaactaagcttgcctttttagcttatacttttccttattataaaacctatgaacctaatgggtggacgatagaagatccaattgactgtcttaaatgccatttacaaataaatgagataaaagaggcaaattgtcgcattttgatgagtcatttaggtattcgttttgatacaaggattgctcaagaattttcagaaattgaccttattataggtgcacatacacaccatttatttgaggaaggggagctaattaacggtacatatcttgcagcagctggtaaatatggtcgctttgttgggagtattgatataacttttgataatcatacactaaaagatattttaatctcaacatgtgatacaaaacaactaactggttatccttcggacagtgactggctaagaagattgagtcagaaggtaaagaacagcttagaaaagaaagtttaatatcctttccagcaccattatcattagaagaatcgtaccaactagtcatggatgcgatgctgttttacgcaggtgcagatgttgctattatcaattctggcttaattgttcagccatttgaaaaagacttttcgaggaaaaatctccacgaatcattacctcatcaaatgcgcctcgctaaattgacagtgagtagtcaagaacttttagagatttatgaaactatttatcaacaaggtcaatttttagcgcaacaaaagattcatggtatgggctttcgtggcaagtgctttggagaagttttacattcgggatttgattacaaaaatggaaaaatagtgtataatgagaaagatattgatgccaaagaagaagtgattcttgtaatcgttgatcagtattattttgcatcgtattttgagtgtttaaaaacgaaaaaagtagacttgcttttcctgaattactcagagatgtggcagcagattatttaataaatatgacactataaatgaaaaatagataaataaagagtagaagctagtcgtttctctcaatgattttagagaaaggagtattatgcgaaaagaagtgacaccagagatgcttaactataataagtatcctggcccacagttcattcactttgaaaatatcgttaaaagtgatgatattgaatttcaacttgttattaatgaaaaatcagcttttgatgtgactgtctttggacaacgtttttctgagattttattaaaatatgattttatcgttggcgattggggtaacgagcagttgaggctaagaggcttttacaaagatgctagtacaattagaaaaaatagccggatttcacgtttagaagattatattaaagagtattgtaactttggttgtgcttattttgtgttggagaatccaaatcctagagatattaaatttgatgatgaaagacctcataagcgtcgtaagtcaagatccaaatcacaatcatcaaagtcacaaactagaaataatcgttcccagtcaaatgccaatgctcattttacaagtaaaaagcgtaaagacacaaaacgccgtcaagaacgtcatattaaagaagagcaagataaggaaatgacctctgcaaagcagcattttgttattcgtaagaaaaaataagaaagggataaactgtaaccgtttattccaccatgaagaaagaaaatattatgcctaaaaaaactgatacacccgcctataaaccctctatttatagcttaactcgcgatgaactaatagcttgggctattgaacatggagaaaagaaattccgtgcttcacaaatctgggactggctctataaaaagcgtgtgcaaagcttcgatgaaatgactaacatttccaaagattttattgcacttttgaacgagaattttgttgttaatcctctaaaacaacgtattgttcaagaatctgctgatggaactgttaaatacctttttgaattacctgatggcatgctgattgagacggttttgatgcgtcaacattatggtttatcagtatgtgtaacgactcaagttggttgtaacattggttgcactttctgtgcaagtggtttaataaagaaacaacgtgatcttaacaatggcgaaatcactgctcaaattatgcttgttcaaaaatattttgatgaacgtggacaaggtgagcgcgttagtcacattgtggtcatgggaataggtgaaccctttgataactataccaatgtattaaaattcttgcgtacagttaatgatgataatggattagctattggtgcacgtcacattacagtgtctacttcaggtttagcacataaaattcgtgaatttgcaaatgaaggtgtacaagttaacttagcagtatctcttcatgctccaaataacgatttacgatcaagtatcatgcgtattaatcgttctttccctcttgaaaagttgtttgcggctattgaatattatattgagacgactaaccgtcgtgtaacatttgagtatattatgttaaatggtgtcaacgataccccagaaaatgctcaagagttagcagatttaacgaaaaagattcgcaaattatcttatgtcaatttaattccttacaatcctgtctcagaacatgaccagtatagtcgtagtcctaaagagcgtgtagaagctttctatgacgttttgaagaaaaatggagttaactgtgttgttcgtcaagaacatggtacggacattgatgcagcttgcgggcaattacgttcaaacacaatgaaacgcgatcgtcaaaaagcgaaggtagggcagtaatgcttaaaagattacttactgaagatggggaattgacaaagattagtcgtcgtttcgtttggatgttagtgattatctattgtcttattattgtcaggatgtgttttgggcctcaaattatgattgagggggtatcaactccgaatgttcagcgcttcggaagaattgtagctcttttagtaccatttaattcttttcgtagtttagatcagctaactagctttaaagagattttttgggttattggtcaaaatgtagtgaatattttactgctgtttcctctcattatagggttactatccctaaagccaagtttacggaaatataaaagcgttatattacttgctttcttgatgtctattttcatagagtgtactcaagttgttttagatattttaatagatgctaatcgggtttttgaaatcgacgatctatggacaaataccttaggcggtcctttcgccctatggacttatcgaaacataaaaggttggcttctaactattagaaaatgaaaataatgtaaaggctatgatattgttcaagccttttactatttaaaaagaatcactttagttgacgaaagtaagcttatagaggcataatagagagttgttaaatgagaattttaaaacacttttcatgtcttctgacttaattatgatgtttttcaatctttgagaaaggaaaaatatgtctattataaaaaatttgtggtggttttttaaggaagaaaagaagcgctatcttattggaattttgtcattaagtttggttgcggtgttaaatcttatccctcctaaaatcatgggatcagttattgatgctattacaactggaaaattaacaagaccacaattgctctggaatttattaggtttggttttgtcagctttagctatgtatgggctgcgttatatttggcgtatgtatattttagggacttcttacaaattgggtcaagttgtcagataccgtttatttgaacattttacaaaaatgtctccttctttttatcagaaatatcgtacaggtgatttaatggcgcacgcgaccaacgacatcaattctctaacacgtcttgcaggaggaggagttatgtcagcagtggatgcctctatcacagcattagtaacgcttatcaccatgttctttactatttcgtggcaaatgacattaattgcggttatccctttgcccttaatggccttagcaactagtaaattggggcgaaaaacccatgaaaccttcaaagaatctcaggcagccttttcagaattaaataataaagtgcaagaaagtgtctctggcgtcaaagtgactaaatcatttggttatcaagaacaagaaattgcttcttttcaagaggttaatcagatgactttcgtgaagaacatgcggaccatgacttatgatgtcatgtttgatcctttagttcttctttttataggtgcctcctacgtattaacattggctatgggagcttttatgatttcaaaaggtcaagttactgttggtgacttggtaacatttgtgacgtatttagatatgttggtatggcccttgatggcgattggtttcttgttcaatatggtacagcgtggtagtgtttcttataaccgtattaatagcctacttgagcaagaatcggatataactgaccctttaaatcctatcagacctgttgtcaatggaacattaagatatgatattgatttctttagatacgacaatgaagaaaccttagccgatattcatttcaccttagaaaaaggtcaaaccttaggtttggtaggtcaaacgggatcagggaagacaagtcttattaagttattgctacgtgaacatgatgtgactcagggaaaaattactttaaataaacatgatatacgtgattatcgattgtctgagttacgtcaactaatcggttatgttcctcaagatcagtttttatttgctaccagtattttagaaaatgttcgctttggaaatccaactctatctatcaatgctgttaaaaaagcaactaaattggctcatgtttacgatgacattaaacagatgccagcaggatttgagactctaattggagaaaaaggagtctcattatctggtggacaaaaacaaaggattgcgatgagtcgtgccatgattttagatccagatattcttattttggatgattctctatcagcagtggacgctaaaacggaacatgccattattgaaaatcttaaaacgaatcgtcaagggaaatcgactattatttcagcacatcgattatcagctgttgtgcacgcagaccttatcttagttatgcaagacggcagagtcatcgagcgaggtcagcatcaagagttgctaaataaaggtggttggtatgctgaaacgtatgcctcacagcaattagaaatggaggaagcatttgatgaagtctaatcaatggcaagtctttaagagattaatctcctatttacgcccttataaatggtttacagtattagctctatctctcttattgttgacgactgttgttaaaaatattattcctttaattgcttcacattttattgatcactatctgacaaatgttaatcaaacagcagttcttattttagtgggatattattcaatgtatgtcttgcagaccttaattcaatattttgggaatctcttttttgcgcgtgtttcttatagtattgttagagatattcgtagagatgcttttgctaatatggaaaggcttggcatgtcttattttgataggacaccggcaggatctatagtgtcacgtattactaatgatactgaagcaatatctgatatgttttcgggtattttatcgagttttatctcggcgatatttatttttacagttactctgtacactatgttgatgctagacattaaactaacaggacttgtcgctcttttattacctgttatctttatattagtgaatgtctatcggaaaaaatcagtcactgtcattgctaaaacgagaagtttacttagtgatatcaacagtaaattatcagaaagtattgaaggaattcgcattgtacaggcttttggtcaagaagagcgcttgaagactgaatttgaggaaattaacaaagagcatgttgtgtatgccaatcgttctatggctcttgatagtctcttcttaagaccggcgatgtctcttttaaaactcctagcatatgctgttcttatggcttattttggatttacaggagttaaaggaggtcttacggcaggattgatgtatgcttttattcagtacgttaatcgtctctttgaccctttaattgaagtaacgcaaaatttttcaaccttacaaacatcaatggtatcagcagggcgtgtgtttgatttgattgatgaaacaggttttgaaccaagccaaaaaaatacagaagcttttgtgagagaaggaaatatcgaatttaaaaatgtatcattctcatatgatggaaaaaaacaaatccttgataatgtttcttttagtgttaaaaaaggtgaaacgattgcttttgtaggagcgacaggttctggaaaatcatctattattaatgtctttatgaggttttacgaatttcaatctggacaagttttattagatgggaaggatattagggattactcacaagaacaattgcgaaagaatattggactcgtcttacaagacccctttttatatcatggcactattaaatctaatatcaaaatgtaccaagacatcaccgatcaagaggtacaggacgcagcagagtttgttgatgctgatcaatttattcagaagttgccagataagtacgatgcagctgtttcagaacgtgggtcaagtttttcgactggacaacgccaactattggcgtttgccagaactgtggctagtaaacctaaaattttaatcttagatgaagcgacagcaaatattgattcggaaacagagcagattgtacaagattcgttagcaaaaatgcgtcaaggtcgaacaacaattgccattgctcaccgcttatcaaccattcaagatgctaattgtatctatgttcttgatagaggaaagataattgaaagtgggaatcacgagtctttattagacctaaaagggacttattatcgtatgtaccaattacaagctggcatgatggaggtctagaaaatttagactattcaaaaggcataatctgtgaggtttagaggttggagtagttattcctctaagccttttttatattttacaattagtgtataatgaggtcaaagtgcaaggaaaggtctataaaatgttactattggtagataattacgattcttttacctataatttaaagcaatatttaagtgtctataaagaggtattcgtcataaaaaatgatgttcctaacctttttttattagctgagagcgcagaagccatcgtcttatcacctggaccaggacacccaaaggatgctgggaaaatggtagaattaatcaatcagtttataggaaagaaacctattctaggtatctgtttggggcatcaagcgcttgccgagtgcttgggtgggcgattaaatttagcaaatcacgttatgcatggtaaacaaagttgggtaacaataaacgaccatactagtttgtttaagggaattgatagtccaacccaagttatgcgttatcattcattggtagtgactgatttaccagagaatattgctgttattgcacgatcaaatgaggataatgaaatcatggcattccattgccccagcttaaaggtatatgcgatgcagtttcatcctgagtcaatcgggagtattgatggaatgaaaatgattgaaaactttttgacgttaattaatgactaaaatgtgttagtgtaggataatgactctctataaataaaagacagtaccttaggtactgtcttttatttagttgtatagatgagttaatctgtttgcaaatttacgataaataatcaagcaaatggatgcttttaaggtatccccaggaataaaaataaggttagaaaatagtgatttagttaagggtagagaagtttgaaaggaaagaacgatgctaccacaaatatcaatcaatagtacgccaaatatccaaataataaggaattgaacccagagttttgttgttttcactttctcaagccctaggccgataaaaaaagctgcaaatggataagtcagcagatagcctgctgttggcccaaacagcgttacgagacctgaccgtcctcctggtaaaaatggtgcaccaatagcaactaagagcaagaaaatagccacagctaggaaacccttcctactaccaagcagagcacctgccagcataacaccaagattttgtaaaacaattgggactggaatgaaacctaatgggatccctgggataaaacctaaaacaataagtagtgcaaccatgagtgcaatataggtagttgttcttgttttcatttaaattaattcctttttagtatgatttagttgtaatttttccaagaattcaatatcggtatgttgattgcgaccgccctctgttaggtaatttcccaaaaaagttgagtcaacaagtaaggtgactaatgattcaaaattctcaaaatggacctctcgtccagcgcttaatcttaattccttgaaaggaaaaacaaaacgcaacatggccataatttttaagcatttaatgggagtcaaatagttatattttccaagaggtgttccttcaacagcaagtaaaaaattgacagggatagaataggggtccagctcttttagtctgaaagctaatgtgatgagcccctcatcgctctctcccataccacaaatgaatccagaacaaacatcaatgtcttcattgtgaattctttctaaagtatcacaacgatctttgaagctatgcgtcgttgcaatgttggggtagttttcttcgggggtgttgagattatgattgatacggtcaattcctgcttgttttagctgatgaagttgttctctatccaaaaaaccagcggtaaggcatatttctagagggaggctttttttgatttcagggatgacttgacataactgctcaatttctctcttgctaggcttagttccactcatcgcaatacaaaagacgctagcaccattttgatgagcgacaatagcctgttttagaatgacattttgaggaagcagaccaaatttatcaatgtcagcagtgctttctttagattgagaacagtaaccacaattttctgcacaaagtccttgcttagcacttaataaaacgttaaggcgaatattatttcggctaacttgatttttaaggtataaggcagcagcgtagatttcccaccagttctcatcgctatttagaatttccagcgcttgttcataagaaatgctagtctttccagataatatttcgtcagccaaatggatataatttgtttgaaatgacatgatagcctcctttaacgaaattaataatagcataaaaaaactatattgtaaacttagtcgatgtcataagttaacaatataaaaattatgatatactggtcttatattttgacgggagataagatgaaaaaactatttaaaaaagcgatagctatgtgccgagatttgccgcttaattttgtaattgttgaacttagtttgtatcaaagagaggatggctcatctgataatattaaatggatttctaagagaattcttgaggtaacggtaactgatcagcaatggatttaccatttgaggatgcttaatttaccaaaacttaagccaatgtcactagcatccagtgactgtcctgcaagggaagagaaggctagtcttatttcaatagaagaatgtcaaaaattcactagcttagtgcgagataaaaatccttttcaccaaggggaagcagctattgtgcctgcggctctattattggaaaaaataatggaagttagaaaaggaaaaataaaggagattcatttgacttttttatctccagtaagggtgaatcaagaattctcagtgcaagtagtggataacacagtgattatttttcagcatcaaatattatggtgaggggaacatatgaagaatagagatgtttatattggttttgggctacgaacacctatcggtataaaagggaagcaatttaaacattaccgtccagaacttttaggagcacaccttttaaatcaaataaaaaaaatagaatcagaatctaacattgatagtattatttgtgggaacacagttggtactgggggcaatattggtcgtttgatgactcttttttctgattatgaatcctatattccagtacaaacgattgatatgcagtgtgcttcatcaagttctgccttgttttttggttatctaaaaatcagtaccggtattaatgaaaaagttcttgttggggggattgaaagtagttctcttcaacctatgagacgttatgctaaagaagataatcgtaacggagaatatacagttgctcagttttctcctgactcttatgctgaaactgtaatgttagaaggggcccagagagtctgtcaaaaatatggttttagaagagaaatgttagataaattggcattcttgagccataaacgcgccttaacagctaaacaaggtggctatttagaagaggtaatcttaccaatggaagggatgcgagatcaaggcgttagaaaactaaaagaaacattttttcaaaaattaccaagattgatggaaaattcacctttgctcactattggaaatgtttgtttaatgcacgatgctgctgcatttctaacgcttcagagtcagaaaacagaattccggattgttcacattgtagaagtagcaggagatcccaagcttagtccagaattggttcacacggctacggaaaaactattaacagaaactcatactaaaatatcggattatgatgcaattgaatggaatgaaccatttgcagcgattgatgctctatttaatcattattatcctgaagagagagaaaaattcaatatttttggagggacattagcttacggacacccttatgcctgctcaggaattattaatatccttcatcttatgcaggcattaaaatataaaaataaacctatgggtctaactgccattgcaggggcaggaggagtcggaatggccatatcaatagagtacttaggagttaagaatgcttgaatcattgaaaacgatagttaaaaccaatagcgataaaaagttatttgatggtgatttacaggtcagttatggagaattttataacttagtaagacaagatatggcgtcacaagacaataggaaacatgtgattagcacacactctctgcttaaccaattagtaagatttgtttcaaagttatgtcaaaaagctcttcctattatttgtaaacctaaccttactcataatgaaataagtcgattagaaaaagaagtgcagtatgctcctcaactagctgattttggtgttctttcttctgggactacagctgatgctaaactattgtggaggagcttcacttcgtggtctgatttttttagcattcagaatgcttatttttcggtcacttccaatagcaaactgtttattcaaggtgatttttcatttactggtaacttaaatttagcgctatcccttttattactggggggaacacttgttgtcacacagaaaaattctgtaaaatactggcagactttatgggaaaaaactggtgtaacgcatctatatctgctccctagttatctcaagttagtggaacaatatagcaaggagactgcgttagacaataaaactattattacctcttcgcaatatgtctctgactcattactggaaggtttatatagaaagcatcctaaagtgtcagtgaaaatcttctatggtgctagtgagctcaattatgtgtcatggtacgatggtcgtgatatccgagataagccacagtatgttggagaaatcgttccaaatgtagctgttaggattaaagagggaagaatttttgtaaaaacaccgtatagtatctgtggcctttcaagtgaatattgtgctggtgattatggtgaactgatagatggcaaattatatctatttggccgtggtggtgattggtgcaatcaatcgggcattaagctctatttacctagattaatcgaaaaaataaaaacatgcccttatatcaaggatgcagtagcatttacaaaagagagtcaaagtcatggacaagagtcacattgctgtattgttttaattgaaaatcagatgcaacaagagtgtttgaagtggttatcggaacattttgaaaagaagtatgggtttaagcattatcatattgtatctaaaattcctttgatgccatctggaaaaattgattatcaacaactcaaaagacagttagcatgagcttttactaaaaaaataaaatagggttaatggattgtaaacctcagttctgatattctttattttgaaagatatcgtgatataatgataaaaaagaaagataaggaataaaatgttatcaaaagcaaaatcacgatatattatccgtgagattattaagttatttccagatgctaaacctagcttagactttactaatgtctttgagcttttggtagctgtaatgctatcagctcaaacaactgatgcagctgttaataaagttacacccgccctttttgaacgctttccaaatcctttagttttggcacaagctgatcccaaagagattgaaccctatatttctaaaattgggctttaccgtaataaagctcgattcttaaatcaatgcgctaaacaattgatagagcattttgatggaaaagtcccccgaactcgtcaagagctagaaagtttggctggcgttggaaggaaaacggctaacgtggtcatgagtgttggatttggtattccggcttttgccgtagatactcatgtcactcggatttgtaaacaccaccagatttgcaaacagtcggcttctccactggaaattgagaaacgagtcatggaggttttaccaccagaagagtggctagctgcacatcaatccatgatttattttggtcgtgcaatttgtcatcctaaaaatccaaaatgcgaccagtacccacaactttatcactttcctgataatttaaagtgattagaataaaagagagtaactggtgacgattatataagcgatacttaaaaacggtagaaaagctatcgtttttttcatttttctcataactaaacaataaataattcctaaccaagcacctatttgaataataaaaagcatttgatgaagaggtaaagataagccaattgtggctaaataaaggaaatctccacttccgatattaatatcaaccacttcagctaaaatcccaaataaacacaaaacaatagaaacttttgtaatcggtgtgagaattatcgttgaaatggtgaataatatccatagaaaaataggatactcttggtattttatatcataataacttaagataaaactcatgcataaagaaataaaatagatggtagacataatcataaaatcctttttatagtttatatttatattcgaaaaatggtagaaaagagattacgatttctattatagatagtcagtctaacgtcataatgacaattagcaagcggttgcggattttcttgaaaattgaatggttttctgttaaaattcatatatgaaagttttattcgatgtgcagaatcttttgaaaaaatttggtatttatgtttatattggtaaacgtctttatgatatcgaagttatgaagattgaattgcaacgtctctacgataatggtctgataagtagagatgattatttaaaagcagaactgattttaagaagagagcacagactagaattggagaaggaaaataaaaaatgagtaagaaattattgggaattgacctcggaggaacgaccattaaatttggtatcttgacgcttgagggagaagtacaagaaaaatgggcaattgagaccaatactttagaaaacggaagacatatcgtttctgatatcgttgaatctctcaaacatcgtttgagcctctatggattaacaaaagatgactttctcggtatcggtatgggttctccaggagctgttgatagaactagtaaaacagtaacaggtgcttttaatctaaattgggctgatactcaagaagtaggttcagttattgaaaaagaagttggaattccattttttattgataacgatgctaatgttgcagcacttggtgaacgctgggtaggtgctggtgccaataatcccgacgttgttttcgtaaccctcggaacaggagtaggtggaggtgttatcgcagatggtaacctcatccatggtgttgcaggagcaggtggagaaattgggcatatgattgttgatccagaaaatggatttacgtgcacatgtggtaacaaaggctgccttgagacagttgcatcagcgacaggtgttgttagagtagcacgtcaactcgcagaacaatatgagggttcgtctgccattaaagcagcgattgacaacggtgatactgttacaagtaaagatatttttatagcagcagaagatggggataaatttgctaattctgttgttgaacgtgtatcacgttaccttggactggcagcagctaatatttcaaatattttaaaccctgattctgtggttattggtggcggtgtctcagcagcaggtgaatttttacgtagtcgcgttgagaaatactttgtcacatttgctttcccacaagttaaaaagtcaactaaaattaagattgctgaactaggtaatgatgctggtattattggtgcagcaagcttagccaatcaacaagcaagttaaggagataaggtatggatatgtctgttattttaattattgttattcttctggcttttgttgcttgggcatcttggaattattggagggttcgtagggcagctaaatttttagataacgagtcttttcaaaaagaaatgtcacgaggacagttaattgatatccgagaagctggtgcttttcatagaaagcatattctcggagcacgtaacattccagcaagtcaatttaaagttgccttatcggctttgcgcaaagataaacctgtcctcttatatgacgcaagccgtggtcaatctattccaaggattgttttgttactcagaaaagaaggttttaatcaactttacgtgttaaaggacggtttcaattactggacgggtagagttaagtaatatactaaggagagagttactattaataactctcttcactttttgtagaaatgaattaaattgaaaaaagtagaaaataaatggcataaataatgaaatgatgaaaagttttcttatcacaaataggcagttaatatgaaaacatttacacttgtgtaaattctgttttttaagaaaaattgtgttataattcataagttaacagaattacattataaaatagaggaaaacatgacaaatttaagaacagatatccgtaacgttgcgatcattgcccacgttgaccacggtaaaacaactctcgttgatgaattattaaaacaatcacatactcttgatgagcgtaaagagcttgaagaacgtgcaatggattcaaatgatatcgaaaaagaacgtggtatcaccattcttgcaaaaaatacagccgtagcatacaacgatgttcgtatcaatattatggacacacctggtcacgcggactttggtggtgaagttgagcgtattatgaaaatggttgatggtgttgttttagtcgttgatgcctacgaaggaacaatgccacaaacacgttttgttttgaagaaagctcttgaacaaaacttaattccaatcgttgttgtaaataaaattgataagccgtcagctcgtccatcagaggttgttgatgaagttcttgaactatttattgagctcggtgctgatgatgatcaactagatttccctgttgtttatgcttcagctatcaatggaacatcttcaatgtcagatgatccttcagatcaagaaaaaacaatggcaccgatttttgatactatcattgatcacattccagccccagttgacaactcggaagaaccacttcaattccaagtttctcttcttgattacaatgattttgtaggacgtattggtattggacgtgttttccgcgggactgtcaaagttggagatcaagttactctttcaaaacttgatggtacaactaaaaacttccgcgtaacaaaactttttggtttctttggacttgaacgtaaagaaatccaagaggctaaagcgggtgatttaatcgctgtttctggtatggaagatatcttcgttggtgagacagtaactccgacagatgctattgaaccactaccagttttacgtattgacgagccaacacttcaaatgactttcttggtgaataattcaccatttgcaggtcgcgaaggtaaatggattacgtcacgtaaggttgaagaacgtcttttagcagaattacaaacagacgtttctttacgtgttgacccaacagattcgccagataaatggacggtttcagggcgtggagaattacatttatctatccttattgaaacaatgcgtcgtgagggatatgaacttcaagtatcacgtccagaagttatcatcaaagaaattgatggtgttcaatgcgagccgtttgagcgtgttcaaattgatactccagaagaatatcagggtgctattatccaaagtttgtcagagcgtaaaggtgatatgcttgatatgcagatggttggtaatggtcaaacgcgtttgattttcttgattcctgcacgtggtttgattggttattcaacagagtttctttcaatgacacgtggatatggtatcatgaatcatacttttgaccagtatctaccggttgttcaaggagaaattggtggtcgtcatcgtggtgccttggtttctattgaaaatggtaaagcaactacatattcaattatgcgtattgaagaacgtgggactatctttgtaaatccaggtatagaagtttatgaaggaatgattgttggtgagaattctcgtgataatgacctcggagtcaatattacaactgctaaacaaatgacaaatgtccgttcagcaactaaagatcaaactgcagtcatcaagacgcctcgtatccttactttagaagagtcacttgaatttttagcagatgatgagtacatggaagtaactcctgagtctattcgtcttcgtaaacaaattttaaataaagcagcacgtgacaaagctaataaaaagaaaaaatcagctgaataatatccaaagtatttcttatttatgattaataagaaaggagttctatgttttacttaattgttgcccttttgattgccttgtattacttttttatggcaccaaaaacagtacgtaatactttgaacgctattggtttagtaggtttggtagccttattacttgtcttggcagttatgagttttattaaaatccttcaattgccaggtgaattgtatattgggcttataatgattcctctaggatatacagcatttaaagaaacattgaatttgtcagaaaagaagaaatagcttatgaacttaggattttgtctcctaagttcttttgttttgagaaattagagacatatcctttaccttgaaaaagccactgattaaaggtaaaataatagggataataatgatagaatgggacgagtaatgaaaacaataacaacatttgaaaataaaaaagttttagtccttggtttagcacgatctggagaagctgctgcacgtttgttagctaagttaggagcaatagtgacagttaatgatggcaaaccatttgatgaaaatccaacagcacagtctttgttggaagagggtattaaagtggtttgtggtagtcatcctttagaattgttagatgaggatttttgttacatgattaaaaatccaggaataccttataacaatcctatggtcaaaaaagcattagaaaaacaaatccctgttttgactgaagtggaattagcatacttagtttcagaatctcagctaataggtattacaggctctaacgggaaaacgacaacgacaacgatgattgcagaagtcttaaatgctggaggtcagagaggtttgttagctgggaatatcggctttcctgctagtgaagttgttcaggctgcgaatgataaagatactctagttatggaattatcaagttttcagctaatgggagttaaggaatttcgtcctcatattgcagtaattactaatttaatgccaactcatttagattatcatgggtcttttgaagattatgttgctgcaaaatggaatatccaaaatcaaatgtcttcatctgattttttggtacttaattttaatcaaggtatttctaaagagttagctaaaactactaaagcaacaatcgttcctttctctactacggaaaaagttgatggtgcttacgtacaagacaagcaacttttctataaaggggagaatattatgtcagtagatgacattggtgtcccaggaagccataacgtagagaatgctctagcaactattgcggttgctaaactggctggtatcagtaatcaagttattagagaaactttaagcaattttggaggtgttaaacaccgcttgcaatcactcggtaaggttcatggtattagtttctataacgacagcaagtcaactaatatattggcaactcaaaaagcattatctggctttgataatactaaagttatcctaattgcaggaggtcttgatcgcggtaatgagtttgatgaattgataccagatatcactggacttaaacatatggttgttttaggggaatcggcatctcgagtaaaacgtgctgcacaaaaagcaggagtaacttatagcgatgctttagatgttagagatgcggtacataaagcttatgaggtggcacaacagggcgatgttatcttgctaagtcctgcaaatgcatcatgggacatgtataagaatttcgaagtccgtggtgatgaattcattgatactttcgaaagtcttagaggagagtaactatggggaaaaaaattgtttttacaggtggtggtacggtaggtcatgtaacactaaacctaatattaatccccaaatttatcaaagatggttgggaagtacattatattggtgataaaaatggcatagaacatgaacaaattaatcagtctggacttgatatcacatttcactctatagctactgggaaactacgtcgctatttttcatggcaaaatatgttagatgtctttaaagtaggggttggcgttcttcaatcgattgctattattgctaaacttagaccccaagccttattttcaaaagggggatttgtttcagtacctcctgtagtagctgcacgcctattaaaagttcctgtttttgttcatgaatcagatttatcaatggggttagcaaataagattgcttataaatttgcgactattatgtatacgacttttgaacaatctaaagatttaatcaaaactaagcatattggtgctgtaacaaaagtcatggattgtaaaaagtcgtttgaaaatactgacttaactagtataaaagaagccttcgatccaaacctaaagaccttactatttattggaggatcagcaggtgcaaaagtattcaatgattttattactcaaacacctgagctggaagaaaaatataatgttatcaatatttcaggcgattcttctctcaatcgattgaagaagaacctttatcgcgtggattatgttacagacctttatcagcctttaatgaatttagcagatgtggttgttacacgaggtggctctaatactatttttgaattagtagctatgaaaaaacttcatcttattatccctcttggacgtgaagcgagccgaggtgaccaattagagaatgctgcttattttgaagaaaagggctacgcattgcagttaccagaatctgaattaaacataaatacacttgagaaacagataaatttattaatttctaacagtgagagttacgaaaaaaacatgtcacaatcatctgaaataaaatctcaagatgaattttatcaattattaattgatgatatggcaaaagtaacaaaaggataaaacatgcctaagaagaaatcagataccccagaaaaagaagaagttgtcttaacggaatggcaaaagcgtaaccttgaatttttaaaaaaacgcaaagaagatgaagaagaacaaaaacgtattaacgaaaaattacgcttagataaaagaagtaaattaaatatttcttctcctgaagaacctcaaaatactactaaaattaagaagcttcattttccaaagatttcaagacctaagattgaaaagaaacagaaaaaagaaaaaatagtcaacagcttagccaaaactaatcgcattagaactgcacctatatttgtagtagcattcctagtcattttagtttccgttttcctactaactccttttagtaagcaaaaaacaataacagttagtggaaatcagcatacacctgatgatattttgatagagaaaacgaatattcaaaaaaacgattatttcttttctttaatttttaaacataaagctattgaacaacgtttagctgcagaagatgtatgggtaaaaacagctcagatgacttatcaatttcccaataagtttcatattcaagttcaagaaaataagattattgcatatgcacatacaaagcaaggatatcaacctgtcttggaaactggaaaaaaggctgatcctgtaaatagttcagagctaccaaagcacttcttaacaattaaccttgataaggaagatagtattaagctattaattaaagatttaaaggctttagaccctgatttaataagtgagattcaggtgataagtttagctgattctaaaacgacacctgacctcctgctgttagatatgcacgatggaaatagtattagaataccattatctaaatttaaagaaagacttcctttttacaaacaaattaagaagaaccttaaggaaccttctattgttgatatggaagtgggagtttacacaacaacaaataccattgaatcaacccctgttaaagcagaagatacaaaaaataaatcaactgataaaacacaaacacaaaatggtcaggttgcggaaaatagtcaaggacaaacaaataactcaaatactaatcaacaaggacaacagatagcaacagagcaggcacctaaccctcaaaatgttaattagcaataaaaaagactggatttatcagtcttttttatatatatcaagtcagtcatagattgctagtaaaaattgatttcttgaaaaaaatttaagtttgttataagttccgaatggtttaaataagttagaaatatttcaatttgatgttgcttaataaaaaaacgtaatttggtaacaattctgctttttttatggtataatattttctgaataattctgtttttggcagatgtagaatagaaaagaatggaaagatagcgaggtcgagtgaatggctagaaatggcttttttactggtttggatataggaacaagctcgattaaagttttagttgcagaatttattgcaaatgaaatgaatgtaattggggttagcaacgtccctagttccggtgtaaaagatggtataattattgatattgaggcagcagcaactgcaatcaaagaggcggtaaaacaagctgaggagaaagcaggcatcaccattgacaaaatcaatgttggattaccagcaaatcttctccaaattgaaccaactcaaggaatgattcctgttcctaatgaatcaaaagaaattaaggatgaagatgtcgaaagtgttgttaaatcagcattgactaaaagcattactcctgaaagagaagttatttcattgattccgcttgaattcattgtagatggtttccaagggattagagaccctagagggatgatggggattcgccttgagatgcgtggtcttatctatactggaccaacaactatccttcataatcttcgtaaaactgttgaacgagcaggtataaaagtagagcatgttgtgatcgcccctctagccttagcaaaatcagttctaaacgaaggtgaacgtgagtttggtgcaactgtgattgatatgggaggcggacaaacaacagtcgcttctatgcgtaatcaagaattgcaatatactaatatttattctgaaggtagcgattatgttaccaaagatatttctaaagtgctacgtacaacagtagaaatcgccgaagcattgaaattcaactttggacaagctaatgttgaagaagcaagtacttctgatacagttcaagttaatgttgttggtaacgaggaacctgttgaaattacagaaagctatctttcgcaaattatttcaggacgtattcgtcaaattttagaacatgtcaaacaagacttgggtagaggtcgtttacttgatttacctggtggtattattcttgttggaggtggtgcaattatgccaggagttgtcgaggttgctcaacaaatttttggaactagagttaaattgcacgttccaaaccaagtaggtattcgcaatccaatgtttgctaatgttattagtatcgttgattatgtaggaatgatgtcagaagttgacattatcgcacaacatgctgtaactggcgacgaaatgctaagacataaaccagtcgactttgattataaagaaaaaacaaatacaatgtcgacaatgccttattctgagccgttaacctcttctatggaagattctaatttagaaccaatccgagcaagagaaaacgctcaagagcctactgagcctaaagctaatattggtgagcgcatcagaggaatttttggaagtatgtttgactaaaacaataagtgaggaataaaaatggtattttcatttgatacagcatcagtacaaggtgcagttattaaagttattggtgttggaggcggtggcggtaacgctattaaccgcatgattgacgaaggtgtcgctggcgttgagtttattgcagcaaatactgatattcaagccttaagtagctcaaaagctgaaactgtcattcaacttggtccaaaattaactcgcggacttggtgcaggaggacaacctgaagttggtcgtaaagcagctgaagaaagtgaagaagttttaacagaagcacttactggcgctgatatggtatttatcacagcaggtatggggggcggatctggtacaggtgcggctccagttattgcacgtattgcaaagagtttaggagcacttacagtagcggtcatcacacgtccttttggctttgagggtaataaacgttctaacttcgctatcgaaggtattcaagaattaagagaacaagttgatacactgcttatcatttcaaataataatcttcttgaaattgtagataagaagacaccattgcttgaagctcttagtgaagcagataatgttttacgtcaaggtgttcaaggtattacggatttgattactaacccaggtttaattaaccttgactttgcagatgttaaaacagttatggcaaataaaggtaatgcactgatgggaattggtatcggttctggtgaggaacgtattactgaagctgctcgaaaagcaatttattcaccacttcttgaaacaacgattgatggagcagaagacgttattgtcaatgttaccggcggtatggatatgacacttactgaagcagaggaagcatcagagattgttagccaagcagcaggtaaaggtgtcaatatttggttaggtacttcaattgacatggatatgaaagacgaaatccgcgtaacagttgttgcaacaggtgtacgtaaagataaaactaatcaagtatctggttttacaacatcagctccaactaatcaagcaccttcagaacgtcaaagtacttcaaattcaaactttgatcgtcgtggcaactttgatatgacagagtctcgcgaaatgccaactcaacaaaatcagcctcatgcacaaaatcagcaacaaagttctgcttttggtaattgggaccttcgtcgtgataatatttcacgtccgacagaaggtgaacttgatagcaagttgtctatgtcaacgttttcagaaaatgatgatatggatgatgaacttgaaacacctccattctttaaaaaccgttaattaaaatgatgaatttacaagaaaataaaacagcgatttttgacaatgttagtaaattagcactaaaagcaggtcgcgctcatgaatcagttcatatcgtagctgtaacaaaatatgttaactgtcaaacaacagaagcgcttattagaacaggtgttaatcatatcggtgaaaatcgtgttgataaatttcttgaaaaatatcaagcattaaaagatgaaaagcttacatggcatctcattggtagtttacaacgtcgaaaagttaaagatgtcattaattatgttgattattttcatgctttagattctgttaagttagcagctgagattcaaaaacatgctcaaaaactaattaaatgttttctacaagttaatatatcacgagaagacagtaagcatggttttactattgagcaaatagatgatgcactgaacttaatttctcggtacgataaaattgaacttatcggcatcatgactatggctcccttaaaagcaactaaagaggaaatatcatcaatttttgaagagactgagagtcttaggaaaaggcttcaagctaggaacatagaacgaatgccgtttacagaattaagcatgggcatgagtagagattatgatattgctattcaaaatggatcaacatttgtaaggataggaacttcattctttaaataatggaggggaatatggcattaaaagatagatttgacaaaattatttcttattttgacactgacgatgtaagtgaaaatgaagtacacgaagtacaagagagaacttcagtgcaaagagattccagagcagctacagcacaggaagcttctcagcgtagtcatatgactaactccgcagaggaagagatgattggtagtcgtccgagaacttatacctatgatcctaatcgtcaggagagacaaagggtacagagagacaatgcttatcagcaagctactcctagggttcaaaataaagactcagttcgacaacagagagaacaagtaacaattgctctgaagtatccccgtaagtatgaggatgcacaagaaattgttgatttacttatcgttaatgaatgtgtcttgattgattttcaatatatgcttgatgcgcaagcacgacgttgcttggattatattgatggtgcaagtagagtattatatggttcattacaaaaggttgggagttcaatgtttctattaacaccagccaatgttatggttgatattgaggagatgaatattccaaagactggtcaagagacgagttttgattttgatatgaagagacgataaatatgatattagtactattaatattattaaaaacaattagggtctattcttatatcttactagcctatgccttgttatcttggtttccaggagcatacgattcatggattggtagactagtggtacagattgttgatccgattattcgcccactcagaagatttaatctacaatttttaggtctagattttacagtaatagtagcattctttttactaaatatgttgagtagatttttaatcttgctttttacataagatgacgttagatgatatttatcagcattttcgaccagaagagtatgcgtttatccataaaatagaccatttagctcaatatgtcgaaaacacctattcgtttattaccactgaatttctaaatcctagggaatttaaaatactcgaaagtgttctagagaggcgaggtagtcattattacacttctggtcagtattttcaaacagaatatgttaaagtaataatagcaccggaatactatcagttagatatggctgattttaaccttagcctaattgaaataaagtataatgctaaatttaatcaccttacccatgctaaaattatgggaactttactgaattacttaggtgtaaaacgatcaattttaggggatatcctagttgaagaaggctgtgctcaggttttggtcgatagtcaaatgacaaatcaccttgttcattcagttacaaaaattggaactgctagtgtacaattagctgaagttcccttgtccaaacttctaactcccaaacaagatattcaaaaactaactgttattgcttccagtttacgtcttgataaaattttagcaacgattttaaagatttcacgaacacagtcgacgaaattgattgaggcagataaagtcaaggtcaattatgcaaccgtcaatcgagtttctgaacaattagtagagggggatttgattagtgttagaggatatggtcgatttacgttgaaccataacctagggttaactaaaaatcaaaaatataagttagaagtagacaaaatgatacataactaaggagaaaacatgccacttacagcacttgaaattaaagataaaacattttcatcaaaatttcgcggttatagcgaagaagaagttaatgaatttttagagattgttgttgacgattacgaggacttgattagacgtaatcgtgagcaagagcaatacattaaagatttagaagagaaaatcgcttacttcaacgaaatgaaggaatcgttaagtcaatcagttattttagctcaagaaactgctgagcgtgtgaaaatttcagcacaggatgaagcatctaacctaatggggaaagctacatttgatgctcaacatttaattgatgaggctaaattaaaagcaaatcaaatccttcgagatgcgacagatgatgctaagcgtgttgctatagaaacagaagatttgaaacgtcaatcacgtgttttccaccaacgtttgctttctgagttagaagggcagctaaaattagctaactcatctgcttgggaagaattgttgaaaccaacagctatttatcttcaaaattctgatgcttctttcaaagaagttgttgaaaaagttcttgatgaagatgatgctttaccagtggtggatgacactgagtcatttgatgctactcgtcaattctcaccagatgaaatggaagaattacagcgtcgtgttgaagaaagtaacaaacaacttgaagagtcaggtttattagatactaataatttccaaatggaagaaccgatcaatttaggtgaaactcaaacttttaaattaaatattgaagattaagaaaaacaaggttttaatattatattatcagcgagtaggagatggtgagagccctacaatccctaatattgaaattatcattttcaatcattctacctgaactattatttaagtaaggtagaaggcttaacccaccttacgggttgttgagggagtaagaaatagctattttctgctctgaattaaggtggtaccacgagctttcgtcctttatgtgatgaaagcttttttatttagcaatttaaaaaattgtgataactattactataagataaggagttagtatgaaattaaaagaaaccttgaatttaggacaaacagcttttccaatgcgtgcagggcttccaaataaggaacctcaatggcaagaagcatgggatcaagctgacatttataaaaaacgtcaagcattgaatgaaggaaaaccagcctttcaccttcatgacggacctccctatgctaatgggaatattcatgtaggacatgcactaaataaaatttcgaaagacattattgtacgttcaaaatcaatgtcaggttttcgagctccttatgtgcctggttgggatactcatggactcccaattgagcaagtattagctaaaaaaggggttaaacgtaaagaaatggacttggctgaataccttgaaatgtgtcgtgattatgctctcagccaagttgacaaacaacgtgatgattttaaacgtctgggcgtttctgccgattgggaaaatccttatattacactaacaccagattatgaagcagatcaagtacgtgttttcggtgctatggcagataaaggatatatctatcgtggtgctaaaccagtgtattggtcatggtcatcagagtctgcccttgctgaggctgaaatcgaatatcatgatattgattcgacatcactctactatgccaataaagttaaagatggtaagggaattcttgatacagatacctatatcgtcgtttggacgacaacaccatttactgtaacagcttcacgcggtttaacagtaggaccagatatggagtatgttgtagttgtaccagtaggtagtgagcgtaaataccttcttgcagaggttcttgtagatagtctcgctgctaagtttggctgggaaaactttgaaattgtgactcatcacactggtaaagaacttaatcacattgttacagaacatccatgggatacagaagtagaagagttggttatccttggagaccatgttacaacagattctggtacaggtattgtccacacggctcctggttttggtgaagatgactataacgttggtattgctaatggacttgatgttgtagttaccgtagatagtcgtggtttgatgatggaaaatgctggtcctgattttgaaggtcaattctatgacaaagtaacaccacttgtaaaagaaaaattgggagatcttcttttagccagcgaagttatcaaccactcatatccatttgactggcgtacgaaaaagccaatcatttggcgtgcggttccacaatggtttgcctctgtttcgaaattccgtcaagaaatcctcgatgaaattgaaaagacaaatttccaacctgagtggggtaaaaaacgtctttataacatgatccgtgaccgtggcgactgggtaatctcacgtcaacgtgcttggggtgttccacttccaattttttatgcagaagatggtacagctatcatgacaaaagaagtgactgatcacgttgcagatttatttgctgaatacggctcaatcgtttggtggcaacgtgatgctaaggaccttctaccagcaggttatactcatccaggttcacctaatggtctctttgagaaagaaacagacatcatggatgtttggtttgattctggttcatcatggaatggggtaatgaatgctcgtgaaaacctttcctatccagcagatctttatcttgaaggttctgatcaataccgtggttggttcaactcatcactaattacatcagttgctgttaatggtcacgctccatacaaagcagtcttatctcaaggttttgtacttgatggtaaaggtgagaaaatgtctaaatctctaggaaatacaattcttcctagtgatgttgaaaaacaatttggtgcggaaatcttgcgtctgtgggtaacttctgttgactcaagtaatgatgttcgtatttcaatggatatcttaaaacaaacatcagaaacttatcgtaagatcaggaatacattgcgtttcttgattgcaaatacttccgattttaatcctaaacaagatgcagtagcctatgaaaatttaggtgccgttgatcgttatatgactattaaatttaatcaagttgtggatacaatcaacaaagcttatgctgcttatgattttatggcaatttataaagctgtcgttaacttcgtaacagttgatctatcagcattttaccttgattttgcaaaagatgtggtttacattgaagcggctaacagtccagaacgacgtcgtatgcaaactgttttctatgatattttagttaaacttacaaaacttttgactccgattctaccacatactgctgaagaaatttggtcatacctcgaacatgaggaggaggagtttgttcaattagcagaaatgcctgttgcacagacattctctggtcaagaagaaattcttgaagagtggtcagcattcatgacgttacgaacacaagctcaaaaagctctcgaagaagcacgtaacgctaaagttattggtaaatctctagaagcacatttaacaatttatgctagtcaagaagtgaaaacgttattaacagcgttaaatagcgatattgcactcttgatgattgtctcacaattaacaattgctgatgaagcagacaaaccagctgactcagtatcatttgaaggtgttgcatttactgttgaacacgctgaaggtgaagtctgcgaacgctcacgccgtattgatccaaccacaaagatgcgttcgtatggtgtagctgtttgtgatgctagtgcagcaattattgagcaatattatcctgaagcagtagctcaaggttttgaagcttaataaaaattatttaacgctatattttgacaaatatcttaccagttttaatggaagaaattggtaagacatttgtttagtagtcatcaaaaaagaagccttgattaggcttcttttaattatgctgttgttggatatgaaatttcaattaacttggcagtatggagtgatttcatctgctcttgaataataatagattgatctattttacgctttaagaagaactcacgaatagcttctaattcttcatctttgatagcacgatatttgtttgaaattaataattcataatgtttaggtgcttttgtaaaaacgacatcggtgttgccagctgaatagacttccactaattttgcatctgtattttggagttgatttcgaactagttcaggatgactactggttgtattaattagtctcataactattttccccctgattcttattaggtttattataacactatttaggaagaaaggtatgaattatttcctagaatggtgatttttttcccaagcttggacaccccatctatggcttcctcgttttagcttttctttagcttcttggataggaaaccaggctagatggttgaaatcttctagtggcgcttgatccttatgataggcagtaacttcataaatataggcgggattatagtagtaagtatcacggtgtctagagtaaaaatattcatcagcttgaccatagtaatggccaattgttgcggaataacctaattcttcaattaactcacgagttaaagcttctaggtgattttcattttcttcaatttccccacctggaagaaaccaagcaccattaggtgcctgtactaaaataattttatcatgagttggatttggaataatagcatagacaccaaatcgtgacctatagtttacattatctattttttcaccgaaagtaggattagtcatagttctctctcctgattgtgttttatgattttaaaagctttaattattttttatttattatactaaaatttttggaatatttccttaataattgtattaaaatttaaagacgaggtaggagagaaacagctttatagaggctattattttttgagaagagtgtgaaaaaaggttgagtttcttactcaaccttttgtactttcttcagtttttttagaagattttattatgatatttccattgctagtcataatagcacgaagttctttttcgcttggattctcaagatagtaatctgtgatagcatcttcaatatgttcttgaatggtacgacgtaatggacgtgctcccattttgggatcgtaacctaaatcaaccaatttttctttcactttatcagtgacatctagatgaataccattgatggcgagacgtgcattaacgtcagataacataatatcaacgatattgaggagattctctttatctaaagccttgaattcaataataccgtcaaagcggttcataaattcagggctgaagaagttacctagttgacctagtacggaattcgttctaccttctcgtgaggcaccaaagccaacgcttgcttcagttttaccagaaccagcatttgaggtcatgatgataatggtatctttaaaactaacagttcttccttgtccatctgttaatcgaccgtcatcaaggacctgcaagaacatatgcatgacatcaggatgagctttttcaatttcatctagaaggatgagcgagtaaggatttcgacgaaccttttcagttaattgtccagcttcctcgtatcccacgtatcctggaggcgctccgactaatttagcaacagcatgcttttccatgtactctgacatatcaaaacgaatcatactatcagctgaaccaaagagctcaattgctagttgtttagaaagttcagttttaccaacgccggttggtcctacaaataaaaaggaaccaataggacggtttgggctaccaagaccaactcgattacgacgaatagcttttgcaatcttaacgacagcgtcatcctggccgatcacatgttgtttcaagtcatctgcgagattaattaattgagattgttctttttcttttaaatcaccaacagggatattcgttttttcttcaatgatgtgctcaattgttttttcggtaataataggtgtatcttgatcgtcgaccttttgttgttgcatttctttatattttgcaatctggtcacggaagtaagctgcacgttcgtaatcttcttcacgagtcgcttgcgcttttaaattttctgcttcaatgagacgttgatcaatttcttttggatcaacaaaatttagtgttaggttcattttagaaccagcttcatctaataagtctattgctttatcaggtaaaaagcggtcctggatataacgattagatagtactgcagctgcttctatggcatcattattatattttacatgatgataatcttcgtattttttttggatacctttcaaaatagtaatggtttcttcaacagaaggctcatcgacttttacaggttgcatacggcgttctaaggcagcgtccttttcgataatacgatattcattgagagtagtagcacctactagttgtaattctccacgtgcaagggcaggttttaaaatattacctgcatccatactaccttcgccagctgtaccagctccaactatttcgtgaatttcatctatgaatagaataacatcttgacgttgacgaatttcttccatcaacttttgcatgcgttcttcaaattgaccacgaatgcccgttccttgtactagactcacaacatccaaacgaataacttgtttgccttgaagtttatgaggcacattaccatcaacaattttctgagcaagtccttcaacaacggcagttttcccaacgccgggttcgccaataagtacaggattattttttgtacgacgattaaggatttcgataacacgaataatttctgagtcacgtccaataacagggtcaatatcaccatggcgggctatttcagtgacattgataccaaattcttctagaatccctttggcttgagaaggagttgcagtttggttgcgattattatttcgtccattaccgtttcctccacctcggtttcctcctgattgtgtaggaggagtgtttggtaaatcttggccattaaaggctctgaaattatttaaatctccaaagaaatcatcaaagaaaggattgatgccaccaggcgcatgtgaaacatgatttaaacctgaaaaaagtggattattagggtcagttttaataatttggtagcaattttgacaaagatcaacttgcttttgttttccattaacatttgtatacaaatgaatagttgattcgtttagtttgcagttttgacagagcataggctacccctttcttatgacatttaactattgatgtgtatatagtcaaatatagtcaaactttatgcttttattatagcacctaaagcctagaaatcaagaaaaaagttctgtttttagcactgaatatattagagtgctaaattgaaaaatagatgactactgagaaaaatcgttatttgcggattttagacgataaaatcgttaaaaagttagtaaaaatgttgcttttcatgttgctttggtcacttttgtgttaaaatagaaaagactagaaaatatataggagtaagtaagatggaatcacatttagtgagaatcatcaatcgcctcgaattaatggcgactgatggtggtaatttaaaacgtaattttgaacgtgaaggtgttgttgtagcagaagtatcttttagtaatgaccctgaaaacggtcctgttttcacattacgtgatgtagaagcgcgtgaatcatattcatttgacagcattgaccttatcgcaatggaaatttacgatttattatactgataattataaaagaccttgaaggtcttttttttatatctaaatatacagtaaaatagaataaaaacaaaaatatttatctaaacttgtatttttattctttgtgtgatagactattggcaattacttttttaggagatgtcaatgaatttttcatttttaccacaatattggtcctattttaattatggtgtgatggtaaccattatgatttcaacatgtgttgttttttttggaactattataggtgtgttaattgctttagtaaagcgtactaatttacattttctcacaatattagctaatttctatgtatgggtatttcgtgggacaccgatggtagttcaaattatgattgctttcgcatggatgcattttaacaatttaccaacgattagctttggtgttttagatttagattttacacgacttttacctggtatcattatcatttccttaaatagtggtgcctatatttcggaaattgtacgtgcagggattgaggctgtaccatctggacaaatagaagcagcttactcgttggggattcgacctaaaaatacacttcgctatgttatcttaccccaagcttttaaaaatattttacctgctctagggaatgaatttattacaattattaaagatagtgctctccttcaaactattggtgtcatggaattatggaacggagcacaatcagttgtaacggctacttactcaccagttgcaccgttattatttgcagcattttactatttaatgttgacaacgattctctcagctttgttaaaacaaatggagaaatatcttgggaaaggggtaaaaatagatggttgagccaattatttcaatacaaggacttcataaaagttttgggaaaaatgaggttttaaaaggcattgacttggatattcatcaaggagaagtagtggttattattggcccttctggctctggtaagtcaacatttttaagaacaatgaatctcttggaagtaccaacaaagggaacagtgacttttgaagggattgatataacagacaaaaagaatgatatttttaaaatgcgcgaaaaaatgggcatggtttttcaacagttcaatctatttcccaatatgactgtactagaaaatattactttatcacctattaagacaaaggggctttctaatcttgatgctcagacaaaagcatatgagctacttgaaaaagttggactcaaagagaaggctaatacttatccagctagcttatctggaggacaacaacaacgaattgctattgcaagaggtcttgcaatgaatcctgatgtccttctttttgatgaacctacttcagctcttgatcctgaaatggtaggtgaagtcttgactgttatgcaagatttagctaaatctggtatgacgatggttattgtcactcatgaaatgggttttgcacgtgaagtagcggatcgtgtcatttttatggatgcaggaattattgttgagcaaggggcccctaaggaagtatttgagcagacaaaagaaatccgcacaagagatttcttaagtaaagtattataatttcattgtctaaaacaacttgttttagacttttattattccattgttatgagtaaattgttactgtattgtttggaagttggtaagtctatatataatgtagactaagaatgatagggtgatgaaaaaaatttagatgctttaaatatattaagtgtagttaatttataaaataagttgactttataaggttaatttgatactattcagttagctcctgaagaactaaaatctcttatcatggagctgatttttaccattttggtcttagaataggatgtctcatatgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatgattactgctagtcataatcctcaagcttataatggttataaggcatattggaaagaaggatctcagattttagatgatattgctgatcaaattgccaatcatatggatgctataaccgattatcagcaaattaagcaaataccctttgaagaggctctggcaagtggttcggcaagttatatcgatgagagtattgaagaagcatataaaaaagaagtgcttggtttaactattaatgatactaatattgataagtcagtccgggtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaacaggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgataaatttggctattacaacgagcgccaattttctcttgagttagagggtgctgaggggcaagaacgtattagtcgtattatggaggattttagacaggacccaatattacaagtaggtgagatgacattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaataagtcatatgtaaaaaggcgatgagggattcattgccttttctattgattaaaattgatacaaaatgaatagcgatataaaatagcataatcgctattttttgatataatatagaaaaaacggatgaagaaggagtatcaatgactgaattaatagatggtaaagccttatcacaaaaaatgcaggctgagttagggcgaaaagttgaaaggttaaaggaacagcatggtatcatacctggtttagctgtaatccttgttggggataatccagctagccaagtgtacgttcgaaataaagaacgctctgcattagaagctggttttaaaagtgagactctacgattatctgaatccatttctcaagaagaactgattgatattatccatcaatacaatgaagataaaagtatccatggtattttagttcaacttccgttaccacaacatattaacgataaaaaaattattttagcaatagatcctaagaaagatgttgatggtttccacccaatgaatacgggtcatctttggtcaggacgaccgatgatggtaccttgtacgccagctggtattatggagatgtttagagagtaccatgtggatttagagggaaaacatgctgttatcatcggaaggtccaatattgttggtaagccaatggcacaacttctccttgataaaaacgcaacagttactttgacacattcaagaactcgaaacctttctgaggtaacaaaggaggctgatatccttattgttgcgattggtcaggggcactttgttacaaaagacttcgttaaagaaggtgctgtggtgattgatgttggtatgaatcgcgatgaaaatggtaaattgattggagacgttgtatttgaacaagtggcagaagttgctagtatgataacacctgttcctgggggcgtaggacctatgacgattacaatgcttttggaacaaacttatcaagcagctcttagaagtgtgagtctatgattgttggtgaacaagaagcgagggcgttaattaagccacgccctaaatcaagccataaaggtgattatggtagtgttcttctgataggaggtttttatccctatggaggtgctattataatggcagctttggcctgtgtcaaaactggtgcaggattagttactgtagcaacccaaagttgcaatatcccctctttgcatagtcaactaccagaggtaatggcgtttgatagtgatgattacaaatggttggaaaaatcaattgttcaaagtgatgttattgtaattggtcctggattaggagtatcagaatcatctcgaaaaattttgaaccagaccatggagaagattcaatcacatcaaagtgtcatccttgacggatcagccttgactctgttatcagaaggtgcgtttccgcaaacaaaggctaaaaatttagtgttgacacctcatcaaaaagaatgggagcgattgtcaggtatcgctgtatcgcaacagacaaaagaaaatacccaaaccgctcttaaatcttttcccaaagggacgattttagtcgctaagagttcgcatacgcgtatttttcaagatttagacgaaaaagaaattatagtaggaggtccttaccaggcgactggagggatgggggatactttgtgtggtatgattgcaggtatgttagcgcaatttaaagaagcctctcctctagataaggtatcagtgggagtttatctacattcggcaattgctcaaggattatctaaagaagcctatgttgttctaccgacaacgattagtgatgagattccaaaagaaatggctagactatctaaataaaaaataagtagagaggtgttagcatgacacttcttttgctttatcgagctatttgtagagcaaataggtattttttaagtttttttggtataatgaagttaataaaactctcatgaggaggtgctatgtcagactatttatccgtgtcgacactgactaagtatttaaaattaaaatttgacaaagacccttatttagagagggtttatttaactgggcaagtgtctaattttcgtcgtcgcccaaaccatcaatatttctctttaaaagatgataaatcagtcattcaggcgacaatgtggtcaggtcacttcaaaaaattgggttttgaattagaggaagggatgaaggttaatgtagttggccgtgttcaactttatgaaccaagcggctcctactctattattgttgaaaaagcagaaccggatggtataggagctcttgctatccaatttgaacaactaaagaagaaactctctcaagcaggttattttgatgatcgtcataagcaattaattcctcaatttgttagaaaaataggagttgtgactagtccaagtggagccgttattcgggatattattacaacagtatctcgtcgatttccaggagtggaaatattacttttccccacaaaagttcaaggagagggcgcagctcaggaaatagcacaaactattgctttagctaacgagaaaaaggatttggatctattaattgttggccgtgggggaggttctattgaggacttatgggcatttaatgaagaatgtgttgtagaagctatttttgaatctcgtcttcccgttatttctagtgtcggacatgaaactgatacaactttagcagattttgtagccgatcgcagagcagcaactccaactgcagcagctgagcttgctacaccggttactaaaattgatatcttgtcttggattactgaacgtgaaaatagaatgtatcagtctagccttcgtcttatcaggacaaaagaggagaggttgcaaaaatcaaagcaatcagttatttttaggcaaccagagcgtctatatgatggtttccttcaaaaattagataacctaaatcagcagttaacatattctatgcgtgataaactacaaacagtaagacaaaagcaaggtttgcttcatcaaaaactgcaaggcatagatttaaaacagcgtattcatatttaccaagagcgtgttgtgcaaagtagacgactattatcaagtacaatgactagtcagtatgacagcaagctagcacgttttgaaaaggctcaagatgcgcttatatcattggatagttctagaattgtagcgcgtggttacgctattatcgaaaaaaaccatactttagtatctactactaatggaataaatgaaggagatcatttgcaagttaagatgcaagatggtcttttagaagttgaggtgaaggatgtcagacaagaaaacatttgaagaaaatttacaggaattagagacaattgtctcacgtttagaaacaggtgatgttgccttagaagatgccattgctgaatttcaaaaaggaatgcttatttcaaaagagttacaaagaactttaaaagaagctgaagagacgcttgtaaaagtgatgcaagctgacggaacggaagtagaaatggatacttgatggttactattgaaaaaattgatgaagctattcatcgttattacaaacagacacatagtgtcgtttctcctgatttgattaaggctatcctctactcagttgatggaggtgggaaacgtattcgtccacgcatccttttagaaattttagagggatttggagttgaactaatagatggtcattatgatgtggctgctgctttggagatgattcacaccggctcattaatccatgatgatttaccggcgatggataatgatgattttcgtcgtggccgcttaacaaaccataaaaagtttgatgaagctacagcggttttagctggagattccctttttttagacccatttgatttagttgtaaaagctggttttaaagctgatgttactgttaggttaatagagttattgtctatgtctgcgggtagttttggcatggttggtggacaaatgttagatatgaagggagaaaacaaagttttatctattgacgatttaagcttgattcatattaataaaacgggacgcctgttagcttatccctttgttgcagcaggtattttagctgagaagtcggaagaagtaaaaggaaaactgcatcaagctggccttttaatcggtcatgcttttcaagtacgtgatgatattttagatgtgactgctagttttgaagaattggggaagacaccaaataaagacattgtagcagaaaagacaacttatccaaatttattgggtttggataagtcacaggaaatacttgatgatactttgaaaaaagctcaggcaatttttcaaaatctagagaaaaaagctaactttaatgctagaaaaataatagatataatagagggattacggttgaatggctaaagagagggtagatgttcttgcctataaacagggactttttgatacacgagagcaagcgaaacgtggtgttatggcaggaatggtgattaacgttatcaatggagaacgttatgataaaccaggtgaaaaggttgcagacgatactgaattaaaactaaaaggtgaaaaactaaaatatgttagtagaggtggattgaaattagaaaaagctttacaagtttttgaaatttcagttgcagataagctaactatagatattggcgcctctacgggtggttttactgatgttatgctacaatcaggagcgcgtttagtttacgcagtagatgtaggaacaaatcaattagtttggaagttacgtcaggatcatcgtgttcgttctatggaacaatataattttaggtatgcccaaaaagaagatttcaaggagggactgcctgaatttgcatcgatagatgtctcatttatctctcttaatttgattttaccagctctaaaagaaattttagtggatggtggacaagtagtggcattaattaaaccacaatttgaagcaggtcgtgagcaaattggtaaaaatggtattgtcaaagacaagttggttcatgaaaaggttttgacaacagtgaccaatttcacgaaagattatggatatacggttaaacatcttgatttttcgcccattcaaggtggacatggaaatattgagtttttaatgcatttgcaaaagtgtcaagatccacaaaatcttgtgcttgaccaaatacaagatgttatagaaaaagcacataaggaatttaagaaaaatgaagaagagtgaacgtttaaatttaattaagcaaattgttcttaaccatgctgttgaaacacaacatgagttgttacgcagattggaagcttatggggtaactctaactcaagcaactatttcacgtgatatgaatgaaattggcattataaaagtgccatcagcaaaaggtcgctatatttacggtttgtcaaatgaaaacgaccctatctttacaactgctgtggcaaagcctattaaaacaagtattttatcaatatcagataagctactaggtttagagcaatttatcaatattaatgtcataccaggtaacagtcaattaattaaaaccttcataatgtcacattgtcaagaacatatttttagtttgacagctgacgataatagtctccttttgattgcaaaatcagaagcagatgctgatcacattcgtcaatcaatgattgcaatgttggagaaaaaagattagtagaggaccttatgcttttagaaatttctattaagaatttcgctattatcgaagaaatttcacttaattttgaaacaggaatgactgttttaactggtgagactggtgcagggaaatctatcattattgatgctatgaatatgatgttaggatcccgtgctagcgttgaagtgattcgccatggtgctaacaaagcagaaattgaaggatttttctctgttgaaaaaaatcaatcattagtccaattattggaagaaaatggcattgaattagcagatgaattaattattcgccgagaaatctttcaaaatgggcgcagcgttagtcgaattaatgggcaaatggtgaatttgtcaacactaaaagctgtggggcattatttggtagacatttatggtcagcatgaccaagaggaactaatgaaacctaacatgcacattctgatgttagatgaatttggtaatacagaatttaatgtcataaaagaacgttatcaaagtctttttgatgcttatcgtcagcttcgtaaacgcgtattggataagcaaaaaaatgaacaagagaataaatcacgtattgaaatgctagaatttcaaatagcagaaattgagtctgtagcccttaaatcagatgaagaccaaacgctactcaagcaacgtgataaattaatgaatcataagaatattgcagatactttgacaaatgcatatcttatgttagataacgaagagttttcaagtttatcgaatgttcgttctgcaatgaatgaccttatggctttagaagaatttgatcgagaatataaagatctttccaccaatctttcagaagcttactacgttattgaagaagttactaaacgtttaggtgacgttatcgatgatttagattttgacgctggtttactacaagaaattgaaaatagactagatgttattaacacaataacgcgaaaatatggcggtgatgtgaatgatgttttagactattttgataacattactaaagaatatagtctattgacaggtagtgaagagtcctcagatgctttagaaaaagaattaaagattttagaacacgatttgattgaatcagcaaatcaattaagtttagagcgccataagctagctaaacaattggaaaatgaaatcaaacaagaattaacagagctttatatggagaaagctgatttccaagttcaatttacaaaaggaaaatttaataaagaagggaacgaaatcgttgaattttatatttcaacgaatcccggagagggctttaagccattggtaaaagtggcttcaggaggagagttatctcgattgatgttagctattaaatctgctttttcacgtaaggaagataaaacttccattgtatttgatgaggtggatacaggagtttctggtcgcgtggcccaggctatcgctcaaaaaattcacaagattggtagtcatggacaagttttagcaatttctcatttagctcaggttattgcaatagcggattaccaatattttattgaaaaaatttccagtgactcttcaacagtttcaacggtaaggcttttaagctatgaagaacgtgtagaagaaatcgctaaaatgttggcaggaaacaatgtaacagacactgcacgtactcaagctaaagaattacttggtagttaactttggtaacgtctttaaaaagctaacattgttaggagaaattaatgttgatacacttaaattttgttataataagggtattgaaatattaaagtatagaataggataggatatgagtaaaatcaaaattgtaacggattcttccattaccattgaaccagaacttattaaagagcttgacattacagttgttcccttgtcagttatgatagatggtaccttgtattcagacaatgacttaaaagcacaaggggaattcttgaacctaatgcgtggaagtaaggaattgccaaaaacaagtcaaccacctgtaggtgtttttgcagaaatttatgaaaaattaatgaatgaaggtgtggaacatatcattgcaattcatttaacgcatacactatcaggaactattgaagcatcacgccagggagctaatattgctggtgcagatgttacagttattgattctacttttacagaccagtgtcaaaaattccaggttgtagaagctgcgaaattagctaaagagggagctgatttagataccatcttggctcgtgtggaagaagtacgccagaagtcagaattatttattggcgtatcgacccttgaaaatttagtaaaaggtggtcgtattggacgtgtaacgggtcttctaagttcattgcttaatataaaagtaattatggagctaacaaaccatgaattagtaccgattgttaaaggtcgcggtctaaagaccttcagcaaatggttagataattttgttgaaagtgcccaaacacgaaaaattgctgaaattggcatctcctactgtggtaaagctgatatggctaataactttagagaaaaactagctgttctaggtgctcctatatccgttttagaaactggctcaatcatccaaactcatactggtgaggatgcatttgctgttatggttcgttatgaataagaaaaaaatacttaccggactttctttttttctggtaagtcttcttttatcttttgggattttttccttgatcattccaaaatcaaatcctaaattaacaaaaaaagacttcctaacaaagaaagttatcccacttaactatgttgctcttggagattctctgaccgaaggtgtgggcgatacaacctctcaaggtggttttgttccactgctatcagaatcactccataatcgatactcttaccaagtgacttctgttaattatggtgtgtctgggaatactagtcaacaaattttaaaacgtatgacgacagatcctcaaatcgaaaaagatttagagaaagctgatttattgacgctaactgttggtggtaatgatgtcttggctgttattcgtaaagagctcagtcatttatcactaaattcctttgagaaaccagcagaagcatataaggaacgtttgaaagaaatccttgcaaaagcaagacaagataatcctaaattgcctatttatgttttaggcatttataatcctttttacctaaactttccacaattaactaaaatgcaaaccgttattgataattggaataaagctacaaaagaagtagttgatgcttcagaaaatgtttattttgtcccaattaatgaccgcctttataagggaataaatggtaaagagggtattacagagtcatcaaatagtcaggcaagtatcactaatgatgctctctttactggagaccattttcatcccaataatattggctatcaaatcatgtctaacgccgttatggagaaaataaatgaaacaagaaaaaactggccgtaatttaaatttctggaaatgggcatttctcttattgttggcaattaacctttccttcacagcagtgattgcaagtcgcttaattcaagtacgtgagcctaatacaggaaaaatttcgactggggtacaagataaagtaaaagtaggtacttttacgaccaataagtcgcaactgaataagacaattgcactttatttaaaacaatatcaaactaagaagatgaattataagatttatgctgcttcatcttctatactatttgaaggctcttatcaattattaggttatgaagtgcctttatacatctattttgaaccttatcgtttaacaaatggcgctgttcaacttaaagtgacctcattttcagtaggaactcttccgcttccagaaaaagatgtgttacaatatataaaatcatcttataaattgccaaactttgtagatataaaacctaaaaaatcggttattaatattaatttgcaagatttaaaaaataaagaaggtatttatttgaaagcgactgcaattgatttagtaaacgataattttagtttcgatatttttaagaaaaagccctaaaatgacgttaaatacttgaccttaagcctttttttagatatcatataatctgttaaaacttatgttgtataagtttagaatttatttggaggatttgttaacatggctaacaaacaagatttaattgcaaaagtagcagaagctacagaattaactaaaaaagattcagcagcagcagtagatgcagtttttgcagctgtagcagattaccttgctgaaggtgaaaaagtacaattaatcggttttggtaactttgaagttcgtgaacgtgcagctcgtaaaggtcgtaacccacaaactggtgcagaaatcgaaattgcagcatcaaaagttccagcatttaaagctggtaaagctcttaaagacgctgttaaataattcgtctagaaaaaccttgtcatatcaatgtttattgatagcgacaaggttcttttttatatccaatactcaataaatgactagagagattaaaggaatttagagtttcaaatgtgttagagcatacccttgaattatcttaactgtgatgttataattcctaaaagataagttaaaagagaggttgcgaaagagaatgtcagaaaaagctatactattaattatccttattgcttttgttattatcgctattataaagatagctctgttaaagttatatatgaatacgataaaacctaaagtagataatgaaggaaacatcataacaaagcctgtaaaggatgatttaacacccgaggaacgtgaagaacgtgaatttgataaagattggtaaaatcaatataaaagagcaaacaaggtttgctcttttattatttttaaaggtaattaagttgtcctcgaaaatcctccaatgattgatagcctttatcagccattatttcttttaattctctgcttacacgctgaaaaatttctggtccttctttttgtaaagcggttccgatttggaccatactagctccacatagaatgtgttcaaaggcatcacggccgtttttaacaccacctgttccgataattttaattgaaggatttaaacgtttgtagaaagcatggacgttagctaaggcggtaggcttgataaaatccccaccgatacctccaaagccatttttaggctttataacgacagtttcatcatcaataacaagtccatttccgatagaattaacacagttaataaaagctaaaggatatttgttaaaaattgtagctgcttgatcaaagtgaacgatatcaaagtaaggtggtaatttgatgcccaatggcttttgataatagctaaagatttctgaaaggatgaggtcagtcatttcaaaatcataagcaatttgaggttttccaggaacatttgggcacgataaatttaactctattaggccattgtaactactgttttcaacctttttaagaataatatgtgtctcttctggtgataaacctactaatgataaaacgtgatttttgctattgtcttgatcttgtaattcagtcacgaaatcaagataatagtcaatacctttattagggagtcccatagaattaattgatccccagtcagtatctgcataacgtggttgagggtttccctctctagcttcaagggtacctgtttttgtaacaaaggaaccagcttcagaattttcaatagctaataactcttccttagtcatacaataaatacccgctgcattcatcaaacaattgtcaaaactaaaaccagcaatttccgtttttagcgataccataatatcctcctgaagataaatttttactattttatcacttgattaatagagctgcaagaaaataatgataatggtaataaaatttcgctaaataacgaacattattgtttgtataaacaataatagtaaagaaataaatgatgctttctataatgcataaaaaataagcttatgtaagcttattttttatgttcggcgtaagattttctttagtaattgaatactcttatattttaatggatttggatagtagcggaaagtacccattttacgaacaatgtaaccattaaaattctgtttaaagcgaagtacgccatctgaaccatcaaaatttccttgaatacctaaaaaattatagaaagttgattgacgctttaaagcctcttgcataacatattcttgaagaactgcaggcgcataaaatttattaaattctgtgtatgagccagagaaaagatagacagtttctttcgggctataaataaagaggctaccagctaaaacaacatcttgatttccaaatttttgaataaaaggttcgacttctttgcgacgtttatctaaactagctagttgattgacaagctcagtacgttgacgatggtatttggcagaatctgtattattttgatggcgattatcaaggactgtaatctgttcttccaatttctttgcatttaattgtaggttatgatcatattccctaaagtttagagttgcaatgacaaattccgccttatctccgaaactatcataaaaatcttgataataatctagagatttatccatatagtcccggcgatcagaagtagaagaagtaatatccttaaagatatgtagttcttcccgcttgaggacacgtatttttataccaaaagacatggcttttttaaccaaggggcgtccttttttagagaaagatttaagaagattttgaggagtgataccttctagatttttaacataatgccaatcaggttcaccgccaggataaccaatatgaagcccatcgtggtgataacctatactagtcaggtcatcaataagataggtgttcggtgcacctttaggcttaccttcaccagtaaactcttggtaggtatcataaggtttaattaataattctaaagcgccctgagatttggcatagttctgtagttctttataaaaatgtttcagatatttagaattggaatgggctggaccagaattgacttccatatgaagtccaccagtcattgggatggtataaacaatactgatgatttccattttcccatcgatttggtagcccatgtaggtaatgtcatacccacgtttttttagaagctttgccatctcaggggtttgcataaacgattgtaaatcgtaatttcctgaataactttcgaactctttagctgttaattctttaagcgccataaaagtatcctttcctaactagctattacgttttttgcgtaaggcatagacataattagaggctttataaagcaatctgttcactggaatgttaaattctccaataaattcctcaatgattggttcgaacttagacttaaaatgatataaaccaccagataagtcattctcaatcccccccatattttgccaaatatttccacgttcaaaagccctttgagctgtttcaaaccaagtgtaaataggagcagaataagatttaaagtaatcgtccataccagcataaatattttctgatgtattaccaaattctagagtgagggttgcagccaatggaataatgtctcggtcataggctttttgagcttctttgagaaaatcaatttctttatttaatcgatcaatcgtaccttggtgttgtttaacttttttctcacgattaagttcaagtgattttattctttcagattgggctatctgacattctttttctattttttctaatcgttttgcaacatctagcgaagccattgtgatgtatgagttattaggatacgtatcaaggagtttttggtagtagtcaattcctctaagatttatccctttacggtcttccgtttttttcatcaactctgcaaaatcttcaagtagttcatggctaccaaattgtatatctactcccttatttttggaagttcgaatagcttgacgagtttttttagacattttatcaagtccaaattgattagcatataggtttgcctgaaaacgtggttggatagtatgagctaaatctgttgtccgaccagtccaatcagcacctgcacgctgtaaatgatcaatggcgattaacccttctttttcatcgggcgaattttcaaaatctttggcattgaccatttttaaatagatgagaggatcacacttgataaagagagctctttgttttttgccaaaagctttaaggtccttaaggaccttagttacaatatctagattggagtaatccatgattggtccacgcggaatatatagcatggagaagccaagaggaagtgatttgatgagaatactagcgctggcaatttgggtttcaccgtcaaaaaagccaagtaattgactaccccagttgtcttttactttgggccaattagaagattgaagtaggtttgtttggttggattcgctcacaaagcgatcgtgttcgacagcggtaatttctctatacatgagtttcctttcttagtgagagtgtctttgtttttttcgaatagtataggctaggttggccaatttatataataatggattgattgctagattaaactcgccaatatattcttcaaacattggattgaagttacttttaaattttgttaaaccatcgttaagacttccctcgacaccgcctagattagcagatacaatatcgtttttgaaagcatcttcgaacaccctagcattcaagagatactgtggataaaatttacggaagctatcatccataccagcatacaacatctccaggacattgccaaaacgaatggacaaaattcctgcaatgacaggctcatctggatatttcttgctaaactcctgaaattcaaggatatattgtttaacagaagcttcttgttgatttagccttgtcaggcgacttttttgatgggatggagtttctgataaatctttttggatttgaagaagttgttctttaaattgcgctaatcttttaggaagattgactttagctaaatagagataggcatcttctccataaattgtcattagttgatggaaatagttttcattacgtaaagctacacctttacgattctcggttaatgctacaaccgtggcgaatttaggtaaatcatcaatgttggcacgataaatttgaacaccgcgatgctttgcatcttttatcagacgtttagtgtgttttggaaagttttcttctatatttgctttggtatagatattcgcttgaaaacgaggttggatggtttcggaaatggctttcgttggacctatccattgggcacctgctgacttaagattatcaattgcctgtctactttcatctatctcttcggcgacattctcttctttaaggtgatattgacgtagaagaagtgctggatcgaattttgcaaaaacagcacgtttctttcgtccaaagttttttagtgtttttaacacaaagttaactaattctttattgctgtagtccataataggtccacgtggaatataaagcattgtaaaaccaagtggtaatgatttaattaagatgctagctacagcaactaattggtcatctttataaaagcctaaacgttcattttgccaatttgattttacttgtgcccactttgaagagtggaggagattggtttgagacgatgcaatagcaaaggcatcatattctttttcggatattccaacggtaacatgatacatcagtttattacccattcacgtagtgcgtaggctacgccactttcctcgtttgatttggtgatatattttgctattttttttagttcaggattgccgttttgcataacaacaggatttccaacaacttcaagcatagcacggtcattttcttcatcaccaatagccattgtttgatctacagttaatcccattttctctgcaaggtggagaagtgcagtgcctttattaacgtttttgggtaaaatttctaaataaaaaggagttgattttacaatagtgtagttatcgagaactttttttggaattttagcaattgctgcatctaagatgtcaggttgatcaatcatcattagtttaatgatttctttgtctcccatttcttcaggagtacgatagaagagcggcatattaactaaagttacttcgtgtattgtatatttaccaatatcacgatttgctgtgtaaattccttcttttgtaatggcgtgcatgtggacgcctaatttacgcgctaacagttcgaaatccagatagtcttcataggttaaggtttctttgatgatgtcatctcctgtggctgtgtcttgaactagaccgccgttaaaggtgataacataatctccctcttcattgagtttcaattcttctaaaagatcttggactccgatgattggacgtcctgtagcaataacaattttaacgccttttgattttgcttcttgaacagctttagccacttcaggtgtaatttcacgcttactatttaatagggtgccgtcaatatctacggcaacaagtttaattgaagtcattttatctcccactctttattcaatatcctaaaatactcaccttatatcttactaaaaaataaagggtttgtcatgaatggctattatctttcgtgagtgtcaaatgctcatttgtgatataagattgaaattcttcttttgtacttgaaaataggctatctaatgtcaacatttcttttggaaaataaaaacgttgatcaccataattagatccagttaatgcttttacaatcggtgataagcttgataattcagcaagttgtccattcttttggataatttgaatttctgttcgtggatttgaatgttcaggccgataaacatcgtaaggtaagtcaaaattagcatggacaccagtgtaataatcgggatcaaaaccaacctgtgagactagttctttcattttaactagattttctttatcagactcttcaaaggtaattgatttaaagacttttcgattgataaaacgattagctaaatctgccaaaatgttatcatcagcttgcatccaagattggaagtaagtattcattaccccatcatctagggctaaataatcttgtaaatcatattgatccgtgaagaaaggaataagatttggagaagtttgttcaaaaaaatcgcgatgggtatcaaataagaagcgagcacgttttagtaaattttgtaagagtaattccatagcacgactggctggatggaaataaacttgcatatacatttggaagcgactaacaatataatcttccacagcgtgcatcccgttacgagcaaaagcaattccagaatcggttggtctaataacgcgtaaaattcgtgttaaatcaaattgtccatagctagcagcagtgtagtaagaatctctgagaagatagtccattcgatcacaatcaatttgactagaaattaattgaacaacttgtttattggggtagctatgattaataacactagctactttatcaggaaaatcaggagccacctttcgtaaaatagcattaatctctgtggtaggattggtgatgatttcctgagtgtaagcttcatgatcagtattgaagagacgctcaaatgtatgagaatatgcgccatgtccgatatcatgtagtagggcggcagccatcgttagcagggactcatttttattccaaagatcagaataatgttcatcaaagatttctgtaactttacgagccagttcataaactccgagacaatgtgaaaaacgactatgctctgcaccatggaaggtaaaagaagtcgttgaggtttgtttaatgcgtcgtaaacgttgaaattctttagtgttaatcaagtcatatatgacttgattatttacatggatataagtgtgaacggggtcacgaaatactttttcattcatatatatattatagcaaaaattgaaacttgagtcagaaattggtagaatagaaggataaaagaagtgagagaagtcatgaaactagaaattaacaataacattcaaattgacaacgaaaccgaaatgattcatgagattcacgattgtcaatttattgaaaaaggaagttacgtttatttgaattatattaatgctgagggcgagagggtagttattaaggcaaatcatgaggaattgcttatgacgaggttttcaaatcctaagtctgtaatgcgttttcatcgtgaaacgcctgctttggttaatatccccactccacttggtgttcaacatttgattacagagacaagtcactatcagtttgatttgtcacagcaaaggttgcatatcaattatgtccttaagcaaacggagacaggagactgttttgcaaattatgaattaaggattcaatggtattaagataactaccattaacaaaagagtagtcgttatgaatttcgtttactgaagacgctgggatctctttatgagagccatttatttgataaactgcagtgtggtttatttcgactagatgaacttcgttttttcccttgagattattagtgatagcaaggataattaattgaaaaatggatttttttctgttacaatgattaacatatcaagggagtagcagacggtttaccgtggcaatgtcgtcattacgaaagaaatttccggcgttgtcttaaacagcgagacttgttttcataaaaacaggtctctttttgtttgtggagagaccaaaggaggaaaggttttgttaaaagaacagaaaaaatccttgttttacacacaaggtcaagaagaggttctaacgtctttagaatcttctcgtgaaggattatcaacgacagaagcgaaaaatcgcttagagatgtatggtcgcaatgagcttgaagaagggaaaaaacgtagtctaatagctaagttttttgaccaattcaaagatttaatgattattatcttactggttgctgcagctctctctgttattacggaaggtatgcatggcttaacggatgcattgattatcttggcggttgttatcttaaatgcagcttttggtgtttatcaagaggggcaagccgaagcagctattgaagccctcaaagatatgtcaagcccaattgcgcgtgttcgtcgtgatggtcatactattgaggtggattctaaagaactagttcctggtgacctcgttatgttagaagcaggagatgttgttcccgcagatttacgacttttagaagccgcgtctctaaaaattgaagaagcagctctaactggtgagtcagtacctgttgagaaagacatatctcaagtagtagcagaggatgcaggtattggtgaccgtgtgaatatggcgtatcaaaattcaaatgtcacgtatggtcgaggatatggtgttgttactaacacagggatgtatactgaagttggtaaaattgcggacatgttggcaaatgctgatgaatctgaaacaccattgaaacaaagtttagttcaactttctaaattattgacttacttaatcgtgattattgcggttattactttcttagtggggatatttgtccgtaaagaaggttggattgaaggattgatgacttcagttgctttagcagttgcagctattccagaagggcttcctgcaattgttacgattgtcttatcaatgggaacaaaaactcttgctaaacgcaattctatcgttcgtaaactccctgcagttgaaactttaggttctacagaaatcattgcatcagataagactggaactctgacaatgaatcaaatgactgtcgaaaaagtgtatactaatggtgttctccaatcatcttcggaagaaatttcagttgataataacactttacgtattatgaatttctccaacgatactaagattgatccttcaggaaaattaattggtgacccaacagagactgcactggtacaatttggtttagataagaattttgatgtccgtgaagttttgaaaaatgaaccacgtgtagctgagttaccatttgattcagatcgtaagttaatgtctacgattcataaagaatcagatggtcgctactttatcgcagtcaagggtgctcctgatcaattattaaaacgagttactaaaattgaagataatggcttggttcgtgatatcacggctgaagataaagaggctatcctaaataccaataaagaactcgcaaaacaagctcttcgtgtcttgatgatggcttataaatatgaaacacaaattccaagtttagagactgatattgttgagtcagatttagtattctcaggtttagtgggaatgattgaccctgagcgtccagaagcggcagaagctgttcgagttgctaaagaagcaggaattcgtccgattatgattaccggggaccatcaagatactgcagaagctattgcaaagcgtctaggtattattgatgcaaatgacacagaagatcatgtctttacgggtgctgaacttaatgaattaagtgatgaagagtttcaaaaagtatttaaacaatattctgtctatgcacgtgtttctcctgaacataaagtgcgtatcgtgaaagcttggcaaaacgatggcaaagtcgttgccatgactggtgatggtgttaatgatgctccatcgctaaaaacagcagatattggtattggtatgggaataactggtacggaagtttccaaaggtgcttctgatatggtccttgctgatgataattttgcaactattattgtggctgttgaggaaggacgtaaagtcttctcaaatatccaaaaatctattcagtatcttctttcagccaacatggcagaggtatttacaattttctttgcaactttattaggatgggatgtacttgcaccggttcaccttctttggattaacttggtaacagatactcttccagccatcgctcttggagttgagccagctgaaccaggagttatgacacataaacctcgtggtcgccagtcaaacttctttgatggtggtgttatgggagctattatctatcaaggtattttacaaactatcttagtacttggtgtctatggttgggcattgatgtatccagaacatgctggttatcgcatgattcacgcagatgcccttacgatggcctttgcaacgcttggtttaatccaattggtacatgcatttaacgttaagtcagtttaccaatcaatctttacagttggagcttttaaaaatagaacctttaactggtctattccagtagctttcattcttttgatggtgactattgttgttcctggatttaataaacttttccatgtaactcatttaagttcaacacaatggttaactgtagttatcggaagtttattgatggtagtgttaacggaaattgttaaatttatccaacgtaaattaggacaagacgaaaaagctatttagtttagctgataaaaaaactcacttagaatatctaagtgagttttttagcaatcaaatattgtcatagagttgcgtaattcgtcttcaaaatatttttttcgatagttttcaaaactatccaaatgcttaacggcattataccttttgctaagattccaggttaaattagggttatgattgggattctgattgacaaagtcaatagttaaattccattctctaatatatccaagtggtctagaatgataagtagtctctccaattttaacgtcgccaaatgagcggtgtgcatgaccaaaaacaacatctttgatatgatatttttggaataaatcatgataagcctgactccccaaaaaagcattaaaaggagagaatctaggatgagtcatcgtgaattgtttatggggaacaaagtgcatagcaataatgatatttgaagaatcgacttttgctaatatttcgtctaagcgttttaaaattgatgcttggatagttacatcattatttggacgttttaaacgtctatcaaaccaaaaagtcttttttaatttttcaacatccttgatgtctctattatttgaaaagctgtaatcataccagccatgaaaagctagtagcatttttttgtcaaatcgataggtttgaaagtcaagacgttggatttctgtttctgttaaatcaagcatatcatggtttcctaaattatagctaagtttaatatgcttttttaagttattgataaagggaagtgtatctttagtaaaatgattagatatatctccagcgatatggaggtgatcaattttttctttcttaagcaaattaattaacgttttcgtctcaaaggtagaaaaatgattgaggtcaatatgtaaatcactcatgatagcaagtttggtcataagggtattgtaccatattgtagttcaaagagttaaacagtaaatttttgaaatagttttagagtcattctataatagatatgtcattgtagaatgcgctttcataagtgtgtttagaagttttatatttaaggtgccttaaggaggtctcatgtctaatttttataagctcttgaaagaaaaatttcctcgaaaagaagatatcgtaacagaaatgatcaatttagaagctatttgtcaattacccaaagggacggagtattttattagtgatttacacggggaatacgatgctgttgattatctcttacggacaggtgcagggtctattagagctaaattattagactgttttgattggcagaaaatagttgctgttgatttagatgatttttgtatactgctttattacccaaaggaaaaattagccttcgataaaatgaacttgtcagcaagtgcttataaaacgaagttatgggaaatgattccgttacaaatacaagttttaaaatatttttctagtaaatatacaaaatctaaagtacgtaagcaattgtcaggtaagtttgcttacattatcgaagaacttttagctgagattgaccgtaacccagagaagaaaagctattttgatactattattgaaaaattatttgaattagaccaagtagaagatttaattatagtattgtcccaaacaattcaagttttgattattgaccatttacatgttgtaggggatatttacgatcgtggtaggtatcctgatcgtatcttgaataggttaatggcttttccaaatttggatatccaatgggggaaccatgatgtcacttggatgggagcagcatctggttcttacctttgtatggtaaatgttatccgtattgctgcacgttataataatattactttaattgaagaccgatatggtatcaatttgcgtcgcttggttgattactcacgccgttactatgaacctctaccttctttcgttcctatattagatggagaggaaatgactcatccagatgaactagacttgttaaatatgatacaacaagcaacagcaattttacagtttaaattggaagcccaattgattgacaggcgtccagaatttcaaatgcataatcggcaacttattaaccaggtaaattataaagatttaagtatatctattaaggaagttgtgcatcaacttaaagattttaatagtagatgcattgattcgaaaaatcccagtcgattaacaagtgaggaagaagagcttttacaacaattgatgatagccttccagacttctgaaagtttaaagaaacatattgatttcctatttgaaaaaggaagtatgtatttaacatataatgataatcttttattccatggttgcataccaatgcatagtaatggtgattttaaaagctttaaaattgcaggaaaaacttatggtggtagggatttactggatttatttgaaagtcaaatacgtctagcatatgctagaccagagaaacatgatgatttggcgacagatatcatttggtatctttggtgtggtgaaaattcttctctttttggtaagaatgccatgactacttttgagcgctattatgtttccgacaaagtaactcatcaagaaagaaaaaatccctactttaaactgagagataaagatgatatttgcactgctcttttacaagagtttgatttgcctaagtttgggcatattgtcaatggtcatacgccagtcaaagaaaaaaatggtgagcaaccgataaaagcaaatggtaagatgttagtaattgatggtggctttgccaaaggttatcagaaaaatacaggtttagctggctacactttgatttataatagctatgggatacaattaatttcacaccttccttttacatccattgaggaagttttaagtggaaccaactatatcattgatacgaagcgattagtagaagaagccaaggataggattcttgtaaaagatacaactattggacaaaagttaaccaaagagattaaagacttagatcacctttatcgtcattttcaggaatatgatgactagtgtttaagtaatttactaattgatatgtaggatttaatttttcagtttcttaccttgtctcttttattaaattgacttaaaataatattatggacataaaggcagaaattcaaaaattagcaaaagaaattggtatctctaaaattggttttacgacggcagataactttgattatttggaaaagtcattgcgtgcttctgtggaagaggggcgcaattcaggatttgaacataaagtcatagaggatcgtatctaccctgaaaggcttttagaatcggctaaaacgattatttcaattggcgttgcttatcctcacaaacttcctcagcaacctcaaaaaacatcttataaacgaggaaaaattacacctaattcgtgggggcttgattatcattatgtggtcggcgaaaagttagacagactatcaaaaggcattgaagagctctgtcgagattttcctttgcaacaaaaagcaatggtcgatactggagctttagttgatactgcagttgcccaaagagcaggtattggttttataggaaaaaatggtctagttatttctaaagaatatggctcttatatgtttttgggagaattaattaccaatttagagatcgagccagacaagcctgtcgattatgattgtggtgactgtcgtcgttgtctagatgcctgtccaacttcttgtttaattggtgatggctcaatgaatgccaagcgttgtctatcatttcaaacccaagataagggaatgatggacatagagtttcgaaaaaagattaaaacagttatctatggttgtgatatttgccaaatttgctgtccttataacaaaggtataaataatccattggcgacagagattgatcctgagttggctcaaccagaattaataccatttttgagtttatcaaatggacaatttaaagaaaaatttggtatgattgctggaagttggcgaggtaaaaatattttacagcgtaatgccattattgcgctagcaaatgctcatgataaaaccgcagtggtcaaattaatagagattattgataaaaataataaccctattcatactgcaacagctatatgggcattgggagaaattgtcaaaaaaccaaacgatgagatactggagtttatgagtaatttaaccttaaaagatgaagatagccgaaaagagttggaattaatccgtcataaatggcaattttaagccttttatggtatttttaagaaccttatgataaaataaaacagattaacaaagattggagaaatctcatggaagtggctgaaattcgccaaaaaatagtagaaaataaagagaagttgactagcttcaggaggtctctttgacttagatcgtttggaagaggagattgctcttcttgaaaatcaaatgactgagccagacttttggaatgacaatattgcagcgcaaaagacatctcaagaactgaatgagttaaaaggtaagtatgatactttccataatatgcaagaattatctgacgaaacagaactcttacttgagatgcttgacgaagatgattctttgaaagaagaattagaagaaaatctaatgcagctagataagataatgggtgcttatgaaatgacgcttctcttatctgagccttatgaccacaataatgctatcttagaaatccatcctggttcaggaggaactgaagcgcaagattggggagatttactcttacgaatgtatacccgttttggcaatgctaatggtttcaaagtagaagtattagattatcaagcaggggatgaagctggtattaaatcggttaccctctcttttgaaggccccaatgcttatggtttgttgaaatcagaaatgggagttcatcgcctcgttcgtatatcaccttttgattcggctaaacgtcgtcatacctcatttgcttcagttgaagtgatgccagagttagatgatacgattgaagtagaagtacgtgatgatgacattaaaatggatactttccgttccggaggagctggtggtcagaacgtcaataaagtatcaacaggtgttcgtttgacgcatattccaactggaattgtggtatcgtctaccgttgaccgtactcaatatgggaaccgcgatcgcgctatgaagatgttgcaggctaagctatatcagttagaacaagaaaagaaagcacaagaagtagatgctcttaagggtgataaaaaagaaatcacttggggaagtcagattcgttcttatgttttcaccccttatacgatggtgaaggatcatcgtactaactttgagcttgctcaggtagataaggttatggatggagaaatcaatggctttattgatgcctaccttaagtggcgcattgaagactaaaaataatgaaggagaaacatggcactaatagaaatgtctggtgttactaaaaagtatcgccgttcaacaactgccttgagaaacttaaatttatcaattcagcaaggtgagtttgtgtatttagttggtccgtcaggtgctggtaaatctagcttgattcgcctcctataccgtgaagaaaaattaagttcaggtagattaaaggtaggggaattcaatctcaataaactcaaacgtcgtcaaattcctattttacgtcgtagtattggagttgtcttccaagattataaattactaccaacaaaaacagtttatgagaatgttgcgtttgcgatgcaagttattggagctaagcgccgtcatattaaaaaacgcgtgccagaagttctagaattagtaggtttaaaacacaagatgcgttcttttccaacacagttatctggtggagaacaacaacgtgtggcaattgcacgtgcgattgttaataatccaaaattattaattgcagatgaacctactggtaatttggatccagaaattgcttgggaaatcatgcatctattggaacgtattaaccttcaaggaacgactgttttgatggcaacacacaatagtcaaattgttaacacacttcgtcatcgtgtcattgagattgaagcaggtagcgttatccgagatgaagagaagggagaatatggttatcatgattaatttctttagacatttctgggaatcgcttaaaaacttgaaacgtaacttttggatgacttttgcttctgtaacatcagttaccataaccttacttcttgtaggcttgttttcatcagttttactgaatgttgaaaagttaacaactgatgtttcaggtaattttactatcagtgcctttttaaatgttgactcaacggatgctcaaaaacaagtcaaagataaggacggaaagctaaaagataatcctgattatcataaagtttacgacaaaattaaacgtatttctggtgtagagaaagtcacttattcaagtaaagctgaacaattaaaagaagttcaaaaagagtatggttcagatgttattgatgatacctataaagatgctttgttagatgtttacgtagttgggacaagttctgcaaaagtttctaagagtgtcagtgaagcaattggacgcattgaaggtgttgattatactaaagaacctattgattcaacaaaactatctaatctcacagataacatccgtatatggggatttggtggtgttgccttattaattgtccttgctatctttttgatttcaaatactattcgtatgtcgattatgtcacgccgtacagatattgaaatcatgagattagttggcgctaaaaattcttatattcgaggaccgttcttttttgaaggtgcttgggtagggattttaggggctatcgttccatcgctgattttctattttggttatcaatttgtgtttaacaagtttaatccaaaatttgagacaagccatgtttcattgtatcctatggatattatggttccagcaattattggtggtatggtgattattggtattattattggctcacttgggtctgtcctatcaatgagacgttaccttaagatttaataaaaagagatgaaatctatttcatctctttttattaattgtagatatcatgttagtggataaaattcgaaataaacgtagccaattgtttttcagatgatttgtgagaaagggtagctttaccatcccctttttgatgtccgtagttaccaaatcggctatggtttcctccgacaatagttcgaaaagtacttgaatttgggaggcgttttttagcttcctcatatttttcccagtttaaaatatgatcattacttgctgtaatggagagtactcttaaatttttatgagataggtcggatttacgtgaagggtaggaagctaataatatgagccctctaacaggggctactttggcattttggctagcaacaactcctcctaaagaatgtccagcaaggtaaacattagttaagtggttctgattaataattgttttagctttatgaggcgataaaactggcaaatttaaaggtgtcttcaaaatataggtattatcccctttgtcagctaaatctctagcaagttgagaataagcttcttcttccacaagagccccttgatagaaaataatatttgcttttaccttacccttgcttctaaaaagaaggtagttcttatggtttgtagcggttttagcaattctcctagctaatggggaggcttggtaagtattgaagtaaatggtcatcccgacggccattaaaatagcaaggatacttgttgttaaccaaagaaaaatagagtgacgttttatgttcattggaagaaaggattaaagtttttttcgtggccaatagttgtattcatgccatggcctgggtgaacactataatgactaggtaaggtgaatagttcttgacgaataccagtaatgaggtcctcaaagttactggtaggtaagtcagtacgaccgatagtttcacgaaatagagcatcgccagtaacgactaattcatctgagtggaaaacaaacgagactcctccccaagaatgaccaggtgttggtaaaactgtgaattcaaaaccatttagttgatagggttgctttaatttaaaaaagttctctgccggtcttgctataacattaatgatatcatcatgacggcctaacccagataaattatcatctggggaagatagccaagcggcttctttttctgaaacataaacaggtggattatcaaaagtatctctgaccaaatctaaactaaaaatatgatcatagtgagtatgagttaagaggatagccactaaaggtttttcaaaggatttaattttagcaataatttcttggccattgctccctggatcaatgaggataacagcttgatcattaacgaggtaataagtattttcaccagcaatgtggtttattgttttatagattttcataatgatagtgtaccaaaaaatcaagactttgttaaaaaaagagtggcggaaaataaatggcaactagtttcagaaaatatgggatctcacagcaatttcttgacaccgttttcataaaggtgtatcataaaagtaatcaataagccaagcctaaagctgaacttagtttaagaacactgactttttgagagcaacctaattggttgactaaagaatatgaggtggaagatatgtcaaaagttgctattgttactggtgctggtcaaggaattggatttgctattgcgaaacgtcttcatgcagacggctttaaaataggcgttttagactataatgaagagactgctcaggctgcggttgataaactatcacctgaggatgctgttgcagttgtagcagatgtttcaaaacgtgatcaagtttttgatgctttccaaaaagttgtagatacttttggtgatttgaatgttgttgttaacaatgcaggtgttgccccaacaactcctcttgacactattactgaagagcagtttgaaaaggcttttgcaatcaatgtcggaggaactatttggggaagccaagcagctcagaaacattttagagaattaggtcatggcggaaaaattataaatgcaacttcacaagcaggatgtgaagggaatcctaatttgactgtttatggtggtacaaaatttgcagttcgtggtattacacagactttggcaaaagatttagcatcagaaggaatcacagtcaatgcttacgcaccaggtattgttaaaacacctatgatgtttgatattgcccatgaagttggtaagaatgcaggcaaagatgatgaatggggtatggagcagtttgccaaagatatcactttgaaacgcttgtctgaaccagaagatgttgctaatgcagtaggcttcttagcgggagatgattcaaattatatcactggacaaacaatagttgtcgatgggggtatggtattccattaaaaatgattaatgctaacactgtgagtttcactcacagtgttttttatatttcttaaaaaattatcttatcttggttattggagtgatggcatctttgaggtatagtcatgttttgttttatagatatagcgtgctataatagacttactatgacccagaaaaaacttagaaaatatgcagtagttgacttggaggctactggagcaggtcccaatgcttctattattcaggttgggattgttattatccaaggaaataaaattattgatagttatgaaacagatgttaatcctcatgaatctttggatgagcatattgttcatttgacaggtattacggataagcagttggctaaagctccggattttggtcaagtggcgcatcacatttatcaattgattgaagattgtatttttgttgcccacaatgtaaagttcgatgcaaatttattggctgagcaactatttttagaaggctgcgagttacgtacaccaaggatagatacagtagaattatcacaagtattttatccctgtttagaaaaatattctttaggggcattagcagaaagcttaaatattgaattaacagatgcgcacactgctattgcagatgcaagagctacagcacagttattcattaagttaaaagctaaaattagtagtttacctaaagaagtgttggagaccattttaacatttgctgataatcttttgttcgaatcctatttattgattgaagaagcttatcaagaagctgatttcgttaatcctaaagaatattatttctggcaaggattggtcttaaaaaaagaaaaagctgttggaaagcctaagaaattatctagtgattttcaagttaacatggctttgttaggtatggatgctcgccctaagcaagttgtttttgctgacttggttaaagcgcattttaatgatcaaacaacaacgtttttagaagctcaaccaggacttggtaaaacatatggttatctcttgcctttattggatcagtctcaaaaacaacaaataatagtatctgttccaacaaagattttgcaagatcaaataatggctaaagaaataaagcacattcaagaactttttcatattccctgtcacagtatcaaaggaccgagaaattacttgaagttagatgcgttttataagagcctccaagtgcaggatcgaaatcgattgataaatcgttttaaaatgcaactgctagtgtggttgacggaaacgactacaggtgatttggatgaaattaaacaaaaacaacgattagaatcttactttgaccagctaaaacacgatggagaagtgactcaatcatcacttttttatgatctggatttttggaaacgcagttatgataaagttgcacaaagtcaacttgttattatcaatcatgcttattttcttgagcgtgttcaggatgacaaagattttgcaaaggggaaggttttagtttttgatgaagctcagaaacttgttttgggactggaaaatttttctcgtgggcaacttgatattagtcaccaattgcaggttattcaaaaaataattgatagttctattccattattacaaaagcgccttctggaaagtatctcttatgagctaagtcatgcagtagaacttttttatcgtcataattcttttgaattttcagagacctggttgaaacgtctaaaaaatagtataaacgctttagaagtagtaggattagatgagttacaaacttttttcacagctacttatactaactattggtttgaaactgacaaagtcaatgagaagcgtttaaccattttacgtggggcgagagaagattttcttaaattttcaaagttcctcccccccacaaaaaagacctatatgatatcagcgactttacaaatcagtcccaaagtctacttgtcagatcttttaggaggattttcaagtataagtacagaaaagatagcgcatgagaaaaatgccaatcagaaagtatggattgatacctctatgcccaatatacttgatttatcaccggaacagtatgcttacgaaatagccaagcgtttacaagatataatgacgttaaagcagcctaccttagtcttattaacttctaaacagacaatgtttatggtatctgattatttggataagtgggagataaaacatcttactcaagataaaaatggcttagcttataacgttaaaaaacgttttgatcgtggagaaagcaatcttcttttaggtacaggatctttttgggaaggtgttgactttgtacatcgtgatcgtcttattgaagttatcacgcgattgccttttgatactcccaaagactattttatccagaaactatcgcagagtttaacaaaagaggggaaaaacttcttttatgactattctttaccaatgactgtcttaaaattaaaacaggccttgggacgtactacaaggagagaagaacaaaagtcagcggtaattattttggatagcagattggttattaaatcttatggacaaaccatcatgcattctcttggtagagattttgaaatttctaaggaaaaaattaacaaggtcttgactgaaatggctaaatttttgatataatggtaaagatcattgtctaaaaataagattttgacagtgcgactcaagattaaataatagtagtacgttgataaaaggaggagtaatgacctatttgtcagaacgtgtactcaatatggaagagagtgttactttagctgcgggagctaaagcaagagaactcagagtacaaggaagagatattcttagtttaactttaggggagcctgactttgctactcctaaaaacattcagcaagcggctattgaggctataacagatggacgtgcaagtttttacacaccatcaagtggtttgccggagttgaagtcagcaattaatgcgtattttgaacgtttttatggctactcccttaaacctaatcaggtggttgtgggaactggtgctaagtttatcctttatactttctttatgacagtactgaatcccggtgatgaagtaattattccgactccttattgggtatcttatgctgatcagattaagatggctgaaggtaagccagtttttgtcacagcaaaagaagttaatcacttcaaagtaactgtggaacagttagaagctgttaggactgataagacaaaagtcatacttcttaatagtccatcaaatcctacaggtatgatttataaagctgaggagttggaggctattggaaattgggcagtcgaacatgatatcctaattttagcagatgatatttacggtcgattggtttacaatggcaatatttttacccctatttcaagcctttcagagtctattcgaaaccaaacgatagtcataaatggagtttctaagacttatgcgatgacaggttggcgtgttggttttgcagtgggtaatcatgatattatagcggcaatgtctaaagtagtcagtcaaacaacttctaaccttacggctgtctcacagtatgctactattgaggctttaaatggttctcaagagtcatttgaaaaaatgaggctagcatttgaagaacgccttaatatcatttatccattgttgtgtcaggtccctgggtttgaggttgttaaaccacaaggtgctttttatcttttcccaaatgttacaaaagcaatggaaatgaaaggatatacggatgttacagcattcacggatgccattcttgaagaagttggacttgctttagtaacgggtgctggttttggagcgccggaaaatgttcgtctgagttatgctacagatcttgaaacccttaaagaagctgttcgtagactgcatgtctttatgggaagtaatgaaattaattaaataaaaatagagagaaacttatgtcaaaaaaacttatttcaattgttgatgttaaagattatgttggtcaagaagttactattggtgcttgggttgctaacaaatcaggtaaaggtaagattgcgtttgtacagttgcgcgatggttctgcctttttccaaggtgtcgcttttaaaccaaacttcattgaaaaatatggtgaagaatcaggtcttgaaaaatttgacgttattaaacgtctcaaccaagaaacatctgtttatgtaacagggattgttaaagaggatgaacgttcaaaatttggctatgagcttgatattactgaccttgaagtcattggagagtcacatgaatatcctataactcctaaagagcatgggacagacttcttgatggacaaccgtcatctttggttgcgttctcgtaaacaaatggctgttatgcaaattcgtaacgctattatttattcaacttatgaattctttgaccaaaatggttttatcaaatttgatagcccaattttatcagaaaatgcagcagaagattcaacagagttatttgaaacagactattttgggaaaccagcatttcttagccaatctggtcaattataccttgaagctggagcaatggctctaggccgagttttcgactttggtccagtctttcgtgctgaaaaatctaaaacacgtcgccatttaacagaattttggatgatggatgctgagtattctttcttgtcacatgaggaatcacttgacctccaagaagcttatgttaaagcattgatccaaggcgttctagatcgtgcgcctcaagcacttgatattttagaacgtgatgttgaggctctcaaacgttatatcgcagagccattcaagcgtgtttcttatgatgatgctattacacttcttcaagagcatgaagcagatgaagatacagattatgaacatttagagcatggtgatgactttggttcaccacatgaaacttggatttctaattactttggagtgccgacatttgtagtgaattacccagcaagctttaaagcattttatatgaaaccagttcctggaaatccagaacgcgttctttgtgctgatcttctagctccagaaggttatggagagatcattggcggctcaatgcgtgaagacgactacgatgctcttgtggctaaaatggatgaactaggtatggataaatcagaatacgacttttaccttgaccttcgtaaatacggctctgttcctcatggcggttttggtataggtattgaacgtatggtaacttttgttgctggtaccaaacatattcgcgaagctattccattcccacgtatgttacatcgtatcaaaccataataaaaaagcgctagctagtgcgcttttttattatggtctttagaatcgttggttaattaaattgggactatgtttttttaacaatgtgattgtcgaaaagacaaggataagactgattagtcgatccatataatctgttccaacttgaacaagtatcaaactacttgtcatgtctaatccaattccatgtaagaattgtgctataatacttgagccactagaggtaattcctttaaaaaggataactgttataactgaagcaataatagttcctggtaaagaaataatcagtgatttccacaataggctagagggtttacaattccttttaatcaagatacccgtaatgatagcaaccacgatggcgactggtgaataataaagtgaaaaaatatcagtagtcatccaattgatgagtgcactgagaaaagcagtgctggcagcgtaccatggtcccaggataactgctattaacaatgtacctatagtatctagatagataggtaggcgtaaaaatagagctaaattagccccaacaaggttgatggcgatagcgattgagataaatgaaattaaacgagcaggtgattttgtcatttgttaagtcctaacatttctaagtcttcaatgatgactgaattttgtgcatgtaataggacggtcataaaatcattccaaaataaattagtattgactgaggttaaaatcttactgttagcatcttttttataaaaatgatactgatctacaattgtttgtcccatggcgattccgtgacaagcaacatcggtatagctatcaaaaccagtagcgatattttcattaacaaagtaagcaatagctaaaggatcatttatcacacatccaataatatgctcatattgccagtgaaaatcgaagtagaactttgtgattttttggataaaacttgatacgtctggattaatacgctccatataagataaatgattgggggttaatacaatatgacgtgtgatgtctagtccaaccatctctatttttttgtcaaggttttcaaatacatattgtgcagcatgaggatcacaccaatagttgtattcagcaactggagaacaattgccatgtgatttaaaacttcctcccatgctaataaatcgcttgcaatgtttgcctaatttgggattagtttgtaaggctcgagcgatattggtcagaggtccgagagctataatagaagtatcatttttgtgttcaaaatagtttgctaaaaaacaatctgctgattcttcttgaaagataattggttgcgccaatgtaaagttattctctccaaggccatccattccatgagtatcctgagcagatacaaattcacgttgtaaaggcaagttatcaccaacataaactggaatgtcgtgacggtttagtaattcaagcgttacaaaggtattctttagtcctagctcaacaggcgaattgcctgctgttatagtaatagcaacaacttctaacttaggatgctgaatagcatacatcagtgctaaggtatcatcaataccgggatcgcaatcgataataattttttctttattcatttgtctcctttcttttaatattagtgaatgttctatgcttttatgaaactattaacaatagtcatggcaataaaaaagatcttggcagttaccaagatcacacgaaaaaatgaatttagttttctaaattcaatcatattttcagtcacttagttttttattctgggaagttttcgaaccagtccgagaaatactcgattatgcacgtgttttattataatatgaaagcactaacttgtaaagattcaaactgaccatttaacagtgtctagattgattgttttagcatttgaaattaattttgaaatcggacatctgctgtgtgctttgttaacgattagcttactatcagataatgacagtttttcaatactagcaacagcgttaacttggaaataaaatcccttacctacttgcttttccttcatgagctggcaagtaacatcaacgcgagattttaggtctttgaatcctttttgttctaaaatagcttttatagttgcatttaaacatgttgaccatgctaaagcaattaattcctcaggattaaatcctggtaaatgatttaaagggtgattggtctccacaatttttccattggagagataaacttttccatcaacgccttgagtgtttgatgaggttacttcataaagcataataaactcctttgggtctagtttaccaaatttgggagcattccgacaagattttactatttagaatgagtttcttttcctctgaagtaaaatcctaattgctagccatttgtggtataatggcataaaacataagagaaagaggtaatcgtaatgtcagacgaacaaatcaaacttgtgattgtaacaggtatgagtggggcaggaaagacagtggctattcagtcatttgaagatttaggatattttacaatagataatatgccgcctactctagtgcctaagtttttagaattagcagcacaatcaggagatacaagcaagattgctatggtagttgacatgcgtagtcgtcttttctttagagaaattaactctattttggatagccttgaaattaatgataatattaactttaagattctatttttagatgctactgacaccgagctagtgtcacgatataaagagacacgtcgtagccaccctcttgctgccgacggcagagtgttagatggtatttctctagagagagaactattagcaccgcttaaaagtatgagtcagaacgttgtggacactagtgaattaacaccaagacaactacgtaaggtcatttctaaagaattctcaaatcaagatagtcaaagttcttttcgtatcgaagttatgagttttggttttaaatatggtatacctttggatgcggatttagtattcgatgtgcgttttttaccaaatccatactataaaccagaattaagagataagacaggtttagatactgaggtttatgactatgtcatgagttttgatgaatcagatgatttttatgaccatcttcttgccttaataaagccaatcttaccaggctatcaaaatgaagggaaatctgttttgactgtggcaatcggatgtacaggtgggcaacatcgtagcaccgcttttgctcatagattatcagaagatttaaaagcagattggacagttaatgaaagccatcgtgataaaaataagcgtaaggagacggtaaatcgttcatgagaaaacctaaaataaccgttatcggcggaggaacgggaattccagttattttgaaaagtcttcgcttagaagatgttgagattacagcggttgtcacggttgcagatgatggtggttcgtcaggtgagttgcgctcagttatgcaactaacaccaccaggagatctaagaaatgttttggttgccttgagtgatatgccgaagttttacgaacaaattttccaatatcgttttgcagaaggtgatggggattttgcaggtcatcctttaggaaatcttattattgctggtgttgctgaaatgcaaggttcaacttataacgctatgcagagtttaacacagttctttcatacaacaggaaagatatatccatctagtgaacatccgctcactctgcatgctgtttttaaagatggccatgaagtggttggagagagtcaaatagccgattataaaggcatgattgaccatgtgtatgtcactaatacttataatgaagagactcctacggccagccgcaaagttgttgatgcaattttagaaagtgatatgattgtgttggggccagggtcacttttcacctctattttacctaacctagttattccagaaattaaacaagctcttttagaaactcgggcagaggtagcttatgtatgcaatattatgacacaacgtggtgaaactgagcattttacagacgcagaccacgttgaagtattgaaacgtcatttaggacaagatgctatcgatacagttttggttaatattgaaaaagtgccagagtcttatatggaaaacaatcattttgatgagtatttggtacaggttgaacatgatttttcagggcttagaaaacatgccagacgtgtcatctcgtctaactttttaaaattagaaaaaggtggagccttccatcatggtgacttcgttgttgaggaactaatgaatttagtaggaacacatttatgagttttacagtaaaagtcaaagaagagctgctaggtcataagagtgaaaataagatggaactgtcagctattatcaaaatgtcaggtagtttaggattagctaaccacggccttaacctttctattactacagaaaatgctaaaattgctcgtcatatttatagcatgctagaagaacattatcatttgcagccagaaatcaaataccatcaaaaaacgaacttacgaaagaatcgtgtgtatactgtttttattgaagaaaaagttgatgttattcttgctgatttgaagttggctgatgctttttttggtattgaaactggtattgaacactctatattggacaatgatgaaaatggaagagcttatctcaggggagcattcttatcaacgggtactgttagagaacctgattctgggaaatatcaactagaaattttttctgtttatctagaccatgcacaagacttagctaatcttatgaaaaaatttatgttagatgcaaaggttattgaacataaacatggagcagtaacttatttgcaaaaagcagaagatattatggatttcttgatagtcattgatgccatggaagctagagatgcttttgaagagattaaaatgatacgtgagacacgtaatgatattaatcgtgctaacaacgttgaaacagctaatattgctagaacaatcacagctagtatgaagactatcaataatattatcaagattatggatactattggttttgatgcactgcctagtgatttaagacaagtagctcaggtgcgtgtggctcatccagattactctattcaacaaatagcagacagtttagaaacgcctctgagtaagagtggcgttaaccatcgcttacggaaaataaataaaattgcagatgaattatagaaggagatattcacatggcttgtacaacaatattggttggtaaaaaggcttcttatgatggttcgactatgatcgctagaacggaagactctgttaatggcgatttcacacccaaaaaattaaaggtaatgacatctaaagatcaaccgcgtcattacaaatcagttttatcaaattttgaagtagatttaccagataacccacttccttatacttcagtaccggacgcattgggaaaagatggtatatggggtgaagccggtattaacagtaaaaatgtagcgatgagtgctacagaaactattacaacgaattcccgcgttttgggtgcagatcctttggtttcagatggtataggggaagaggatatactcactttagtgcttccctatattcagtcagcgcgagaaggtgtggagcgtttaggtgctattttggaaaaatatggaacctatgaatcaaatggtattgctttttcagataccgaagaaatatggtggttagaaacaattggtgggcatcattggattgctcgtcgcgtacctgatgatgtttatgttactaatcctaaccaactaggaattgatcattttgaatttaataactgtgatgactacatgtgctctagtgatttgaaagagtttatcgaacaataccatttagatttgacctattctaatgagcatttcaatcctcgatatgcttttggtagccaacgtgataaagatcgtcattacaacacaccaagaagttgggcaatgcagcgttttttaaatcctgaaattgaacaggatccacgtagcttgtttattccctggtgtcaaaagccttaccgaaaaattactgttgaggatattaaatatgtgttgagtgatcattatcaagacagtgtgtatgacccatatggaccagaaggggatgcggtaagtaggagagcttttcgttcagttggtatcaaccgaactagtcaaacgtctattctacaattacgaccaaataaatcacttgaaacgacaggtgttcaatggttatcttatggctctatgccatttgcaaccatggtgccgttgtttacacaagttgagactgtaccaaactatttttcgaatacaaccaaggatgcttcaacagataatttttattggaccaatcgtttaattgcagctctagcagatccacacttttatcaacatgaagctgatattgaaagctatatcgagagaacgatggctcaaggacatgcacatattaacggtgttgatagagaagttgctgagaataaagagattgattttcaacagaaaaatcaagaaatgagtgactatatccaaaaagaaagccaagaattgttaaatcgtattctatttgatgcaagtaatttaatgacaaatcgcttttcaatgggagattaaaaaactcggaatattttccgggttttttaagataaaaacgcttgcataagtatataaaacttgcaaaaaaaaaatatcgtgctatactttactagtaaaatattaaccggtaaataacgggttaaataaaaaggagaaaaaatgagaaagaaatttcttttattgatgagctttgtagctatgtttgcagcttggcaacttgttcaagttaaacaagtttgggctgatagtaaacttaaagtggtaacaactttttacccagtttatgagtttacaaaaaatgtcgttggtgataaagctgatgtatctatgttaattaaagcaggtacagaaccgcatgattttgaaccatcaactaaaaacatcgctgccatccaagattcaaatgcttttgtttacatggatgataacatggaaacttgggctccaaaagtagctaagtcagttaaatccaaaaaagtaacaactattaaaggtactggcgatatgttacttactaaaggcgtcgaagaagaaggtgaagaacatgaaggacatggtcatgaagggcatcatcatgaacttgacccacacgtatggttgtctccagaacgtgcgatttctgttgtagaaaacatccgtaataaatttgtcaaagcttatccaaaagatgcagcttcatttaacaaaaatgcagatgcttacattgcaaaattaaaagagcttgacaaagaatacaaaaatggtttgtcaaatgctaaacaaaagagttttgtgactcaacacgcagcgtttggttacatggcgcttgattacggtttaaatcaagttccaattgctggtcttactccagatgcagaaccttcatcaaaacgtttaggcgaattagctaaatacatcaagaaatataacatcaactacatttattttgaagaaaatgcttcaaataaagttgctaaaactttagcagatgaagttggcgtgaaaacagctgtgcttagtccacttgaaggactttctaaaaaagaaatggcagctggcgaagattacttctcagttatgagacgtaatttgaaagttcttaaaaagacaacagatgttgcaggtaaagaagtagctcctgaagaagataaaactaaaacagttgaaacaggttactttaaaactaaagatgttaaagaccgtaaattgacagattactctggtaattggcaatcagtatatcctcttcttcaagatgggacacttgatccagtttgggattacaaagctaaatctaaaaaagatatgactgctgcagagtacaaaaaatattatacagcaggttacaagactgacgtagaatcaatcaagattgatggtaaaaaacatcaaatgacctttgtacgtaatggtaaatcacaaacatttacatacaaatatgcaggttacaaaatcttaacttataaaaaaggtaatcgtggagtacgttatctctttgaagctaaagaaaaagatgctggtcaattcaaatatatccaatttagtgaccatggtattaaaccgaataaagctgaacacttccatatcttctggggttcagaaagccaagaaaaattatttgaggaaatggaaaactggccaacatacttcccagctaaaatgtctggacgtgaagttgcccaagaccttatgtctcattaatatttaaaagatgatatcggatacgatatcatctttttttctttgtacgtgataggctcaaacatagaaaaaagcacttctaatagaagtgcttttaaaattaatgctatgcttattgagcagcgtttgcgtctttgagaccatattttttgttgaaacggtccacacgtccatctgcttgagtgaatttttgacgtcctgtatagaatggatgtgaatctgatgagatttccacacgaataagtgggtaagtttcaccttcgaattctactgtttctttagttgatttagttgaaccactaaggaatttgtaacctgtagttgtatctaagaaaacaactggacgataatctggatggatgtcttttttcatctttaaaaatttcctttctgccataactcgtctgagtcatagttattaaccactctattctatcaaataagaatagtcttgacaagtgttttgataaaaaaagtaaaattataaagaaagtatttcctggatttcttggtaaatagcttgattctcttccaaactataagaattagctccgctggctaaaggatgtccgccaccattatgacgtttagctatttcattaatgatgtgtgacttactacgtaggcgcacacgataatgcccatcgctttgttcaacgaaaattgcccaactttctacaatatcaatttttccaggtacaccaacgattgcagcagtctctgcatctgttacatcgaagcgttttaggtcttcttgtgttaaagtaacgcatgcagcgccgttcttgtcaattttaagttgctcaaaaataaagccttgtaattttgcaattttgaaaggaaaggaatccatttgacgtgccattgcagaaaaatcaaagtcaaattcacgaagtttgctagcaatcttcagtgttttacttgtggtagcaggatataaaaagcgtcctgtatctcctacaataccattatatagaactcttgctgcacttgttgataacaacaaatcacaagaaagagcaaagtctgtcacaatttcacttgcactagaggcgttagtatctacataagagagatctccatagacttcatcgtttggatgatggtcaattttaattaaaaagtcaccttttttataacgttcatcatcaatgcgtggggtatttgctgtatctgtaacaacaacaagagcgccttgatagtcttggtcggtcacttgatccattttagcaatccaagcgagagtgggttcgtcaaaaccagtagcaagtacttttttctttggaaaattatgcctgatgatatcccttaagccgatttggctaccaagagcatcagggtctggtctcatatgtcgatggataatgatggtgtcgtactctttgattttatcaagaatttgttgaaaaataatcattttttacctacctaactgttttgtcttttagtgaagaacaaggctatattgttgactatattatagcttaaatcttttattgaggaaagaaattaagatagcggtcacaatgtttgtttatttttatatgatggtatgttatttttttataaaattcggatactgctaactaataatcttttttataataatattttgtaaatgtattgctttttagctaacttttgttaatatagtaaaaatgctttttaataggagataaattatgacacaagcagtattaaaagaattggctaaggcggagttgcattgtcatctagatggctcactttctttaccagctattagaaaattggctaatatggctgatataatactgccgagtagtgataaagaattaagaaaatatgttatagctccagctcaaacagaaagcttggtagattaccttaaaacgtttgagtttatcagaccgcttcttcaaacgaaggaagcattacgttttgctgcttatgatgttgctagacaggcagctttagaaaatgttatttatattgagattcgttttgcgccagaactctctatggataaaggtttaactgcaagtgatacagtccttgcagtcttagaaggtttagcagacgctcagaaagaatttaatatcgttgcacgcgcccttgtttgcggtatgcgccaatcgtctcataaaacgaccaaggacattattaaacacattgttgatttggctcccaaaggcctggtaggttttgattttgcaggtgatgaattttcctatccaacagatagtttagtagatcttattcaggaagtaaaacgctcaggttacccgatgactttacatgcaggtgagtgtggttgtgctaagcatattgcggatagtttaaatttagggattaagcgtatgggacatgtgacagctttaacaggacagagggatttaataaagcgatttgtcgaagaagatgctgtagcagagatgtgtttaactagcaatttacaaacaaaagcagcctcaagtattcaaagttttccttatcaagaactttatgatgctggaggtaagattacaattaatacagataatcgtactgtttccgatacaaatttgacgaaagaatatagtcttttcgtaacttattttggaacgaaaatagaagactttcttgttttcaatcaaaacgctgtgaaggcctcctttacaagtgattcagagaaagatactttactacataagctacaagaaaactatgacagctatctaaaataaccttcacgattctttaaaaatatgatagaatagtggtaatttacaagtggaggaagatatggctttagcaaagattgtttatgctagcatgaccggaaatactgaagaaattgctgacattgttgctgataaattacgtgacttgggtctagatgttgaagtagaagagtgtacgatggttgatgctgcagattttgaagatgctgacattgcaattgttgccacttatacatatggtgatggagatttaccagatgaaatcgtggacttttatgaagatttagcagaggttgatttatctggtaaagtttacggcgtagtgggttcaggtgatactttctatgattacttctgcaaatctgttgatgagttcgaggctcaattcgcattaacaggagcacaaaaaggtgctgattgtgttaaagttgatttagcggcagaagacgaagacattgaaaacttagaagcttttgctgaagaaattgcttctaaacttaactaagctaccaaaaagacgaacacgagtcgtctttttaacttttttaccatcttttgtaactagaatatgagatatagatatggaattagaagagattcgtcaagaaatagatgaaatagatcagcaattagtaagccttttagaaactagaatgggtctaattttagaggtcatagcatttaaaaagaaacatcgacttccagttttagataataatcgtgaaaacgaagtgcttaacaatgtattgaagaaagtccaaaaccatcaatttgacgatgtgatacgagcaactttcaaagacattatgacagaatctcgtgtttatcaaaaggagaatattgtagacggtgattaaacgatttgataattatgctcagtacgtacttgttttaggttttagcttactaattggtggtgtggttggggctattacagcagtctttggacgtgttctattattcctgacagcctttagaagtgattatatagcttacctactcccttttcttagcattgttggtttatttatagtttttgtctatcaaaaatttgggggtaagagtgttaaagggatgggattggtatttgaagtaggtcatggtaatgaggagactattccgaaacgtcttgttcctctcgtgatattaacaacttggttaacccacttatttggtggtagtgcaggtcgtgagggggttgctgtacagattggggctaccgtttcacactactttcaaaaatattgccgtttacaaaacgcttctcaacttttcctagtaatgggaatggcagcaggttttgctggtttatttcagactcctttagctgctactttttttgcgattgaagttttggtagtaggtcgtttaatggtttcgtatgtattaccaagtttaattgctgccctgacagcaaatttcgtctcacattctttaggtttagaaaaattttctcatagtatagcaacatcaatggcgttaacaccagatattattctaaaattattggttttaggactatgttttggtctgtgtggtaatttatttgcttatttattggctaaagctaaattaattgcttctagtaggttgctaaacccatataaacggattttcacacttggattgttagctacttttttattgtttatcttccattttggacgatattcaggactgggaacaaatctaattgaggctagcttcactaataagaacctttatgattatgattggttgttaaaattgtgtttgacagttattactttggctgcaggttatcagggaggagaagtaactcccttatttgcaatcggagcaagtttaggagtgattattgcgcccattttaggtttgccagttattttagttgctgctttaggctatactagcgtttttgggagtgcaacgaatactctgttaggtcctatcttaataggaggcgaagtctttggctttgccaacactccttattttgttattgtatgtcttgttgcttactccatatcacatgctcatacgatttatggtgctcaatctagatagttagtgatgagttttaaaagagtttatcagtttgtagaacggaatattccgttctcttttttattctcttaaagtttataaaaatggagtttgtcaattttatgaatgcaaaaattatgtggctaatataatttcttcaaagaaattgattttatgattgtcattaaaatactgtaaaatccaattgaatgtgtaggaacttaggttaggataatgtctacaagcatttaagtcgcgatggtgaaatgcattataagataaaaagttgatgtggatttcaactttatgggaaagagttaagtgacacgaaagctaatatagaaaacgtagcttaaaaaatcaaatattaaatgaattaaactctcaaaaatcagaaaaaagctaacctagaaacagtaaatcaaatttaaataatagacttcctgcgaaacaaaatatggtacaatagttctatgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaactagcgaattattctggtaaaaagaaatgtcatgctatgaaggctcaggcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattttagtttcgcaggaagtctaatatacaaataactattctaaaggatgacaccttgttcttctagataaaatagctttacaagtaggttaaaatttggtagaattgtgagagtgtgtgatggacgcacaaaaaacggctaatccgctgagacaagtacttaagattagtaagagaaggagaataaaaatgaatccattaattcaaagtttgacagaaggtcaacttcgttctgatatccctgagttccgtgctggtgatactgtacgtgttcacgctaaagttgtcgaaggtactcgcgaacgtattcagatctttgaaggtgttgttatctcacgtaaaggtcaaggaatctcagaaatgtacacagtacgtaaaatttctggtggtatcggtgtagagcgtacattcccaattcacactcctcgtgttgataaaatcgaagttgttcgttatggtaaagtacgtcgtgctaaactttactacttacgcgcattgcaaggtaaagctgcacgtattaaagaaatccgtcgttaattttgatgatcagattttaaaaatgcttggttgtttgaggatagtaactatgttttaaaactggacaaccaagacgtaaaaaatctgcctgtgggcagtttttttactaggtccccttagttcaatggatataacaactccctcctaaggagtaattgctggttcgattccggcaggggacatgtaaataacgtcaaaagcctttgtattaaaggctttttgttttattccgattttaaaaggggcacaaaaggggcagtttgtttatttataatttctttcatatttacagttgtgtgactgtaaatagataatgttgtttttggatcgctgtgaccaactctatccattatcgcatttagcggtatccctttttctgctaaaaatgatatatgcgagtgtctaaataagtgcgtgtgataatctccataaattttcaatcgcttattgatgtacgcgtttaaaatcggtacaccgttcgaatttggaaagacgaatgaacttgtctttttctgtctattgacgatatctaaaatattatctgatacagatattttgcgtgttgattttttggtcttggtcgtagtgatttctcgtgtgttaaaatcgtaagttgcattaatcagaatttctttattttcaaaatctattttgtcgtaagtcagacaagataattctccataccgtacacccgtcaaaaacatgaataaaacgatgtctgcgagcgtttgttcgtcattgtctatcattctattgcacaggtcgtaaacctcgttagatgttaaataaagcaccttttcaggcttgtaatcatcctttggtttgggaactaagacgttctccgtcggattacttgtcatatagtccatttgtatcgcataagaaaatatggcatgcaatctctttctacatttatgcgtaacatgatacgaattgtgttttaatagtttatcaatgattagtctaatatcacgtttagtcaacttgttgataattgtatcatctggtaacacggttgctatatgactgtcagatactaaataaccacgttttgtggagtctttgacggtcggtatccattgctttagatattcctttttaagttctccgtaagtcatttctgagtgatttctgatagcgagcctatcttcaatcttttcctgcaatattaaaccagcttttttctgagcttgactagaatttttatctagtgtcacagatacttttttgtacttatttgttagagggtcagtatatctttcgatatatttaaatttcccgttggctagctcctctatccacattgttttatacctcattttctgttaaaataggtatggtaaaaacccctcccaaaaagcaggtttttactatactagaatttgcctcacgctctccttggacaaaatttgagcgtggggcttttttattttgtcttaaacgttcttccacaatttgtgcaatgccagttgtttttaccctttttcccaaccaaacctagcaataagaacggccaagcaattaaaaatccgatacaaccgacacaaccattaaaacctttacggtcttggttcataaattgtacttttgtactttggcagtaaggacaacgctgtgcaaaaaatcccatttttaattctcctaattttgatttcagcttttaacgtggttcagatattacacatagttattaattttcctatttacgtttcgactggggtaaaatggcacgttatacaaaatgacgtttaaataatttatggctttcaatgttctgatcaacatctttctcatcccaaatttgcaactcccaaggatagtagtgattgctcttattcttgaaataaacgtgtattcctgtgtaattatctttatctcgtaaataccagttttttaagtcaaacttatctttccattcatcaagttgttccatcacttgtgaaatatcctcagaagataaaatgatacgagcgccaaaaatgtcattgagaatagaattcacaggataaccatcttgtcttttggaaaaacgttcaattttgtctaagatactttccgatgtttttacgcgatagacataaggaatatccttaacatcagctttcatcaagtaatcattgatagattcgtgtaaattcaagcggtaatctaaaatcgcttgaacaggtacttttgaaaaggtatgttttagattaatcttttcaactttcccagtttcaaaataatcttgcgaataaacaaggtgtattctattaatttccgagattaagcgttcaactttttccagcatattaattctccctgtaaatatctacgacttctcctatcgtgcggatgttgtcgttctctgaaagatagatttcctcatagcttttatttaaactttgcaagtaccaagcgccgtcataatcacgtttgagtttttttacaaagttttttccattgacttggaatatccctatatcattcatatcgacttgactagataccttgacgaacagtaaatcgttatcttgaataagtggttccattgaattaccagctactttcgcaatagtatcatacttatcggggacatcatcagcccgtagtttaacttccatatgtaaattgtcttcttggtatgcccccagaccagcagcaactaacccctcaacgtagtcagtgatataattttctgtctcctcaacttttctatcgaacatagaaacaactttattttgttcttctaattgttcgttagcgaagctaaggactttttcttgtctaggttgttctaattgagaagaagtagaagtgattttttgtagggtagaggaagttagatttttttcagttttcgtttcatttaacgcgactatctgattttcgtctagcgaatttaataaatcatcaaaagagatgccaattgtgtcagaaactttctttataatcggaatagatgggatgatttcttttccgttacgaggatctctgtttttttcaagaatagaaacgtaagctttgctgatgcctgattctttagcgaattcagccatgctcagattattggtatctcgatacttttttatatattttcctagatgcatatcgaattcctttcaatataatgtctaacattttaaacatattatacagtacaaaaaaatttttttcaagttttttgtccaacatacttgacaatcatttgtctaacatgttagactataatcaagcttaaggaattaagcaaaacgaaaggaggtacagctaatgaaatctaggctaaacaaaaagcctaaacacaaagaagtcgagttggaaattcacattctttggtttaagcttaggattcactactcaatagagtggtgacaataccaagagggctaagaagccctctcccctaacggggtaagtttagtttagcacattggctgtatctccgcaagaatgaaaggagagtagatgtggaagaatctatattgaactctaagcgctacacaaaacttgtcgtagagacagaagatggcaaaaaaatagcagaagttactttgacggaagcaacccctgctgatggatacgtgattaggttaacccctaattatgactaacctttaggtgggaatggatcgttaccatagctgttacgttcgcgaattcgtccatttttgccatggataataacttcactgctattgtttttagcgataccagtagcgatttcgacagcttcggcttgggttgttgtgtgtttggtcgcacgactgttgcctgcaccttttatatcccaaccgccattagggttaggtacgacatgttgatttttagccattagcttatcctcctttcgttaaggataagttgattataacatttttaggaggtacaaaatgaattggaaaaaactaatgctaggcgatttagaacacacgtttactagtcgtgatggcaaggaaaaaacaagcgttgaatttgaaggcggcgtattgccagcactgttagtgctaggtggtatcacttggctgatcgcttggcttattacaaaataaaaactcccatgagggagtaggaggaaggtatggagtttatttatttactaattataccatcaatagtttcatttgttgtatctatcttttggtcaaaactagtcttcaaaaaagtagtagaaattatgacaaaaatggatgttgatcaacaagagctgaatgaaacaatgagagctcaaattttagaagaaatcaaaacattacgaaacgtcaggtaaacaagtttttgaaaatctaacaccaaataaagtaagagttatcattcctagatttgttagtactcttttgttttgttcttttaattcactgttctttttagttataaagctattattaagaatgttgtaatattctttctcatctacgtgtgctttgtaattaatttgaattagtcctagtctttctaaattagttaatgatgaactttgaatagctatatcattttgttctaaattatctacgaatacatgactagcaatatgctctaacggcttatcttgaccaattattgtcgtatagtaggtaccagttgcaacgaaaccttttttaaagtataaatctgagataattttgaaattttgtgcatcaattttatcaaactgttttattatctcaataaaagatggatggttgaattcattttttgatttatccatagatgaagcaatcaattttgtaaataaatttctaagttcttcttcttctaaataaaatttagatgcttctaaagccggtccagctatcgaaagactaggttcttgtagattttcaatatttttactaacaacatcttgtatttctttagctaatttttgaataaaatcgtttctgttagtaatgtacttatttcttcgattttcagctatttcatgtaatttttcaaaaccaattaatgtcattaaatcatcaatagctcttgcaggattttcagctttctttatggcagtagttcctaagagagtagcagaaccaagcaaaatcgtctttatatcaagactttcaatcataatacaactccgttttttatttcaattataccacagaaagggggtgggggaatgcaacaatttaatctaaaacaactacgagagaaaaaaggatttactcaaaatgaattagctgataaagctaacgttagtcgttcgctcgtggttggtttagaaacaggttcatattcagagacatctacagcatctctgaagaaattggcgaaagctttggacgtaaagattaaggatttatttttttaactaatcgtctaacatgatagacaaaatatttgttaataaaactaacaaaccgctagaaaggaactatatgaatcaactaataaacatcaccctaaacgaaaatcaagaaccagttgtcagtggtagagatttacacaatgtacttaatataaaaactcaatatactaaatggcttgaaaggatgtcggaatatggttttgaagaaaacgttgactatatagctattagtcaaaaaagactaacagctcaaggtaaccgtacagaatatatagaccacgttctcaagctagacatggcaaaagagattgctatgttacagcgaaacgagaaatcaaaacaggtacgcaaatacttcatccaggttgaaaaagacttcaatagtcctgagaaaatcatggcgagagccttgctcatggcagataagaaaatcactaacttaacgatggaaaataatcaattgcagttagatttaaaagaagctcaaaagcaagcgcgttatcttgatctaatcattgagagcaagggagctttgcgagtaacacagattgctgctgattatggtatgtctgtcaataaattcaataaaacactattagaatttggtgtgcagcacaaagtgaatggacaatggattctctataaacgacatatgggcaaaggttacacagacagtcacacatttgactatcaagacaaaaacggccatacaagagccaatgtgacgacgacgtggacacaaaaggggcgtctattcctgtacgagttgttgaaagacaacaatattttgccactaattgaacaggaagacattgtatagaaaggaaacatatgagaccaaaacaatatccgtatagcggaaataaaaaagaatctattgcggtaacagtagattccaaaacgctagccgagaaactagagattactgaccaatcgaatatttcccaagcgaaacaccgattatttggtctgtaaacaagtagacaaacggcattttgaattcttgatgtgaagatgaaatcaaggtatcagcttagacgaatttagataagaaaaaaagtccgacgggaatcggactcaaaacaaacttaatttacttaattatatcacagaaaggaaacaatatgctagcaaaacttaaaagcggtatcgaagtaccttacgaagagctttggcttaatgataacgacttatccgaatttattggaaagtcatttgaccaaacgcagcgattactaagaaagatgtacaaagacagaaattatcgcaaatacattgacaaggttggcggtcgttcaacaaaagttaaaaaatttgaagaatggagaaaattacaaaatgaaaaaattatttaactttattttcgcaaaacaaaaaagaagaaagaccaaaatggacaattgaaacacatgtctaaacgggaaagtgctatatgacctagcagacgtcaatagatctctacgaacaagtggatcgagaaaaggagtatgatatggaaaatccaatgacaggagtagcaatactagcatttatcgctttacttgcatatctcggcaatcgtaatagcaatcaaaagacaattactaagactgttgagacggtgttagataactaccaagttgtgcgaaaggttgagagaccaaaacgcacggattttatagagttacctaccccaggatcatgcgggaaagtttggggcaaggatagacctttttaaggagtattgaatggcagataacaaaaagtattactatctaaaattaaaagaaaatttttttgaaagtgatgaagcaatcattttagaaagtatgcctgacggctatatctatagcaatattttgctcaagctatacctaagaagtttaaaaaatgacggtttattaatgtttaacaaccttatcccttacaacgcacaaatgcttgcaacgattacaagacatcaggttggcactgtcgaaaaggctattcaaatttttagagacctacaactaattgaaattcttgataatggtgctatatatatgacaaatattcaaaattttgtcggaaaatcaagcactgaggctgacaggatacgaaaactaagagcaaaaaataacagtggtgtacaaatgttgtacaaatgtacaccagagatagagatagagaaagataaaaagatagatataaatatagataaagagttagaactagaacaagataaagaagataggtttgttgatgttgttgaagcaaatcttggtagaggtcttgtaaagtttgagttcgacatgattaatgactatctcattggacaaaatgtctcaaaggatttgtttttggaagctgttaaagtagcagttgctaataatgtccgcaaatttaattacatcgctcgcattttggataattggattaatgatgggataaagactcctgaacaagcatatcaggctcaaagagactttaaagctaaaaaagctaacaaaacaatgcaatcacaatccaacgttcctagctggtctaatccagactacaaaggaccagatttaaaagaatttgcactaggaagcatagacgatatagaagatggatcaggagatttttaatttttttaacaaacaaatcaaaaaagattttggtaaaacggcgagtaaagagacttttgctaagtttgctagttactgcgccgaaggaatcgaaaaaaatggagttaagccaatttttaattggataaacctatacgcttttggaaccggtatgacaacagcagaagcagaccgattaagaatagagcgatataaacaggagaatacgttatgacaaaacaacatagagaaacgcttatctggtaccgagcaagtcatcaagagcgtgagaagctgcttgattttgggctagttgataaatcacagtacgtgacactattgcggcaattgcgcaagaaatatgcgatttaggaagggatatatggttgaaatcagaattaacggtgagtcaatcacatttgatagcaattttagggatgcgcttatatttacggtagatcacctaaaaaattatgacgatccttctttgaggcagacttacaacgagtttaaagattatacagacgaggacttgatgggatatatcagcacagaatttgatgtagacccggaaatgtttgttgatactaattcagacagcagatggaaaattaaacaacgaattttagaggactgactgtgaacgaagaaatatatgagtctagtcgttactggcaaagtagatacagcgacttgatgtctgattatcttaaagaagctgaagaaaatatagagttaaagaaacagttgaagagattaaaagccgaaaattggcagctgaaacacagaaagaggaaatgatatggcttatttatacgaattagaaggtatttacgcacaattacagtcaatggatttagacgaagaaacattccaagatacacttgacagcattgattttcagtcagacttagaaaataacattgagtattttgtcaaaatgttaaaaaatgtgcaggctgatgctgaaaagtataaagccgaaaaagaagctttttataaaaagcaaaaacaagcggaagccaaagcggaaaaatacaaagagacgatcaggcttgcaatggaattgagtcaaaagaaaaaagttgacgctggaatgtttaaggtgtctttgcgaagaagtaaaaaagttgagattttggacgaaacaaaaattcctcttgattacatgcaagaaaaaattgaatacaaaccaatgaaagctgaaatctcaaaagctttgaaatctggaattgatatatctggagttgaactaatcgaaacagaaagtttgcaggtaaagtaaatgaggaaatcagaaagtataacagaatatgctaaagccttttgtaaagctcagctagaggtaaaacaaccactaaaagataaggataacccatttttcaaaagcaaatacgtgccgcttgaaaatgttacagaagcaatcacaacagcttttgccaataacgggatatctttttcgcaggacccgacaacaaacacagaaaacggttatatcgatgttgcaacgcttgtcatgcacacgagcggcgaatgggttgagtacgggcctttaagtgttaaacctacaaaaaatgatgtacaaggcgctggttcggctatcacttacgcaaaacgctatgcactatcggcaatttttgggataacaagcgatcaagatgatgacggcaacgaagatagtaaaccaaacaattccaggcaatcgccaaaagctacaactaaaaaaacacaaaagacaggatatcaaacaccaaaaatcagcaatatccaaatcgagacttacaagtctgatttaaatgatattgcgaaagccacaaaccaaaacgttgaagagttaacaaaatggctaaccgatactttaaaagtgggggaactagaaaatttgcatacggaacacattgtttcagcagacgaattaatcaataaactcaaaaagaaagcaggactaaaaaatgattaacaacattgtactagtaggtcgcatgaccaaggatgccgaacttcgttatacaccaagtaatcaagcggtagctactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtatctatgtaacagaagttgttgcggaaaatttccaattattagaaagtcgcaatagccaacaacagactaatcaaagcggcaatagttctaattcttattttggcaatgccaacaaaatggatatttcagatgatgacttaccattctgagtgtttcgctaagcttctctcaatctaacaggtgaaagtcctgtcctaacaattaaccagttcggttaggtagctatggcatacgtatgcggagtaatccaaatgcggaagcaatgccgactaacgttatccccagtaggctgatattcattggtcttatctcagtccgtgggagcgagcaaacctacagtccgtaacgaaagtgaacttccgctaagtgtcgttaaggtcattccaatgagtataactgagagagttggaaatagagttgtcgagcctttagaatgggggcgaagactggaattgttgtcagttctaactggtatatactggcaataaagctctcggcatatagaagatggaatgtaggtaaagatgagcgaggaacgaaagagacccttttctatcatacatatcccatgtatgtaaggttagatataaggaaaacaccgaagttctaattgacgtaggaatagggagtcggagaggttcatagtaccgataatcatacgagacaacaaaactcgatgtagagaaggagccttgcctttatcggtcttaccgatgaaagaggaactagatgattgctcagaaagctataaacatctttgaaaaggttcaagtatttcaacggaagatatatctatcgaccaaggcagataataagcgaaagtttggtgttttatacgacaaagtatatcgtaaagatatcctgaaagttgcgtggttctatgtaaaaaggaataaaggttcggcaggcattgatgacttcacgattgaagaaattgaagcctacggtgtacagaaatttcttgatgaaatagaagaccagttgagaaacaagaaatatcaacctaaggcagtaaagcgagtttatattccaaaagcgaatggtaaaaagagaccgttgggaattccgacagtccgagatagagttgttcaaacagctgtgaaaatagttatagaaccgatattcgaagcggactttcaagaattttcttatggttttagacctaagcgaagtgctaaccaagctataagagagatatataaatatctcaattatggttgtgagtgggttattgatgccgacttaaaaggttactttgacacgatacctcatgataagttactacttttagttaaggaacgagtaactgataagtctattatcaagttacttagtttatggctagaagcaggtatcatggaagacaatcaagtgagaagtaatattttaggtactccacaaggaggtgtcatatcaccgttgttagcgaatatctacctaaatgctttagacagatattggaagaacaatcggttagaaggaagagggcatgatgcccacttgatacgttatgcggatgactttgttattctatgctcaaataatccgaagaaatattatcagtatgcgaaacagcgtattgataagctaggattaacattgaacgaagaaaagacaagaattgtgcatgcgacagagggatttgattttctaggctatacgcttaggaaatcaaaatctcacaaaagtggtaagtataaaacctactactatccttcaagaaaatctatgaaatcaataaaaggcaaagtaaaagatgttatccaaacaggacaacacctgaaccttcctgatgtcatggaaagattgaatccaatgttgagaggatgggctaattatttcaaagctgggaactctaagcaacacttcaagagtatagataactatgtcatatataatctaacaattatgcttagaaagaagcacaagaagtctggaaagggatggagggaacatccgccgtcatggtactataactactttggactggtttgtttaaggaagttgagtaccaatatcaatgatgatagtcagagatatggtagataacttgtgaatggctataacgtcgaagaaagaagatattgggaaagccgtgtaagggaaaaccttacgcacggtttgacgaggggtttctgaggagatggctcaaatcagcgacctactctacaaaaatgacgaagccgaggaaacaaaggatatatgcaatatatgatgacgacaaatttgtcgacgttggcacaaaagaagagttatcggcacggcttggaattaaaaaagcaacaatagaacagtacatgactaaatcatatcaagcgttagctagctcaaaacgaattgcattgttggtagggattgaagaggaatatgacttttaagacagaatttgaaataccaatcgaaccaaaacctcaaactagacctaagttcagcaaatttggtacgtacgaagatccaaagatgaagagatggcgaaaagaggtttctggatggatagaaaaaaattatgatggaccgtttttcgatgattgcataaaggtagaggtaaccttttacatgaaagcccccaaaacgctatcaaaagagcctacacaacgttctaaaggtaaaacaatacaaatatatcagaacttcgtgcgtgagcttatatggcacgctaagaagcctgatattgataatctgattaaagctgtttttgatagtatttccgatgcaggttacgacagaatacagaaatcaggtatcgtttggtcagatgacaatatcgtatgcgatttaagagcaaagaaaaaatacagtcagaatccaagaataaaagtgaggattgaagagattgacagatgaattaataaatcaattttacaaaatttttgacaatgggattgtaaggcaaattaaaaagctagatgtagattgtaaaaaagccgagcaaataagatgtagcgttacaaataacagacgtcgaaaaaccctgccaagaccgtacgttatcgaagcgtttaaagattattttgacgaagatacctatgcacagatgtatatcaaatcatatcgtgagtatcacaacccaaatgaccacgagacggaactttttgtaaaactaaaaagagcgcacaaagatactaagttagagcattacaaggaagttaagcgattgatgtacgcagcaatgaccttttgaggaggtatagcatggcagataaaataaacgcagagagtatgcaagctgcatacaacgaaaattatcaaatgtttttagctaaaaatgcggattatggaaattcgttcgaaaagtctttggatgacttcggatttatcgctggtgtcgtccgtataagcgataaatacaacaggttatataatcttataaacagtgacaaaaacgtctcagaaagcctgtcagacacgttaaacgacatggctaattattgcgtgatgttagcggtttggttggaggaagaggaacgacaccgaaatttagagcatgggggataaccgatgttaattaataaaaatttagtaagagacattagacttgctatcaatgaatacgatgataattatgacgaagataacgcagaagtttgtatagaagtcattagacgattgattgaacaggaggaattctgatgataccgaattttagagcgtttaataaagagaccaaaaagatgtatggtgttgacggctttgaattaagtgtgcgcaaaatatatagatgcagcttagcagatgatgagtttcgttgtggtcgcttagagacgtttcattttgtcgaggataactttgacgattatatcctcatgcaatcaacaggaatgtttgacaaaaacggtgttgagatttttgatggtgatatagttttaacaacacgtctcatagattacacatataaaaattttaaaggtgtagtaaaaatgttagaaggtcgctggttaattgacacaggtaaagatgcggttggtttgtggactgaagttgatgagaacgaagcaatcggaaacatatatcaaaacagcgaattactagaaagcgtggaagaatgacaaaagaagaagtaattgcatttctgacagaacagcgtgatttgcggcttgttggatatgagtggggaaaagacaatctgtccgtttttgcgagatggcaattagaacaagcaaatatgtatttagatgtcattgagtggatagaggagatgacgaaatgactgaacaacagatgattgattgcttgctttatgagttagcaaaaaaagacaaattgaacattagacgaaacaatatcataacgtttttatcgattgtgctgatggctatatctattttaaacgtcgcactgcaagaccactacaagtcgcaaattacagaattacggacacagttaagcaggacacaaaagcagcttaaacgtgctagtgatgatagagctagacagacaaaacggattgctgagctgactggaaatgggggataaagttgtcattaattgatgaagtaaaagaatgcggttcagaatctcacaaaaaatggtttgataggtactttgatggtttaaaaatcgaggagaaacttaaacagtctgcgatgaaaggattctctggttataaaatctctattccaaaaaatgatgaatacttagctagacgacttgatagccaaaaaacaatagatttactaaaataccgacttggtgacggttttgatgtcgaaataaaaaatcttgaatcatcatataaaatctttggtaaaccagttgtactaagtagagatttatttattttttggaggacaggagataagaatggatgataacacagcagttgttttgatacttttaatattatttttaccgtttattatcggaagttttagagattaagcgaggtaacaaatgaatattgaagacattgaacgtattatttcagaatatctaatttttaggtctgacattgatggttgtgcagtaattgacattgaagattttttaaagcatattcgtttttcgtatgagcgactaaaatagcaaggataatcatgtttataaatgggtaaatgacaaaaaaggttatagaattgagtacaatgaatgcagtgaagtatttttggaggtagcaaatgaatattgaagaagcgaagaaattgatagacaaacagtctattggtaaaggtggtgtcggcgacattccagtagtgaaaacacatattgtaaaagtattactcgaccagattgaccaacctcaaccagaagtgccacggtttgtggctgattggtacgagaagcataaagatagcttagagtgcgatttatatttatatcacatgtcgatatacgatgaagaagtcgaaaaagatgacttctattactggatgcaaacatcaaaaaatccagtctacacacttattaatatgcaccaattcggctacaccatccaaaaagagaagctgtatacggttgagatacctaatccgaatgaaagacagttaagttttgtgctgatgagacaacttagcggaaatgtaagtatcaaagttatgcatagagataacttagacttactaaagacagataatgatttacaactaacagaatccgaaatccgcaaagatttcgactgggcgtggcagtttagagaagaggtggtggaatgaaagaaaaaacaatttttatatcaaaaaaatatgcaaatgactttaacaatgacaaatataatttgtcctctggctattattttagaagtggtgaaaaacatgatattgctattgttaaatatggtgaaaaagattatttaaaaaatactgatttagcatatgttgtatgcgataagatcgttgacgcagactctataagcttcgtttatcatggtgaatatgaaacttggcattttaaactattaaacacagaagcaaattaaagtcccacgcaagcgcctaagagcctgcaatggctctgtgggtctacgagctggaatactcgttaaacttaccctggaagctttctgtaagtattcagctagcagatttggaataattagtctgctagttatagagcgaaatttttagaaagggaaatatcctccgacattttttcgtaaaaatctaaagtctgttatcgctcacagatgattatacaagcgtaatgctgcaaataaagtgctgacgcaaaactaaaaatttaatactcgacaatttaacaacaaaaataagtcagcagagaaatgaaaggagaacaataaaaaagccagctcacgtaagccagctccaatatatttgtctactaatattatatcataaggagtagcttgatgggtcgtaatcagacaaaagctgacattttattaaacgaattaagaataatcccaaaacttattaaagagcttgaacgtgataagattgcgagcaactcgctgctgtcaagtcctcagtggtcagacatgcgaacgagcggagggattagacaatcacaagaagataaaaacgtcagcttgattagtaaatgtgagtattacaacggacaaatacagacactagataaacgtaaaggcgagattgtcgaattaattatgcgtatacctgacatgctgcaacgtcatgtgttaattactacatttgtaaattgtcagacgtacgacgaagcgatcgacagattagagatgaatcgcaataactactatatgcttaagcgaaaaggtgtagaaagtctgaatttgatactaaataatactgaataatactatatcagtattagaaatgactgaataatactcacaaatactaatcaatgtcatataatagtattatcaaaatagcaagaagagataatcatttaccaactgactatttatttagtcgtcaactttaactactatcaaacttgctattttatgtatgtgggacgtacaggttcgaatcctgccgtctcagtagtggttatttcagccactagagcaatacagcgggcgtgggacatggatcggagttttaaccgtttttttgtgtagacctagtggtattaatcacgttcgattcgtgatgggtctataggcttactttaaaaataagcactggtatctctacggggacctttgcgccaagtaagactaaaccgttggaacatgaaccgtgattggaaaacggtagaggtagcgccttgataattggattgtcgacggtctgattatatgtgtcggttcgattccgactgttcctatagcgtgtattggcaacaaggttcaattccttgtgatgtaagtagctaacatctaggcgaagtggttcgaatccactcacacgctttactcagtcatcacattgtggtggctttttattacaattgtaagaggggatgttgcaaactgcgtgcagataaaaaaggtacccaccgggtcgcgttcgaaaaaaataaacgccggctgctaaaaaccgcccacctatgcggtatctgtggccggccagtagataagtcattgaagtatccacatccgctaagtgcagcaattgatcatattgttcctattgcaaaaggtggtcatccgtcatcaatagataacttacagttaacacattggcaatgtaataggcaaaagtctgacaagttatttatcaatcagacagccgtacgggctactgttgtaggaaatagaaacttacctcaaagccgagactggtcgtcctacgcatctaaagaataaatatgatgatttatattaagaagacttaaaatcgattagaattgattttaaggggcatatagaccctatcggctatgtggccgagcttcacgccgtcactgtacattttttctcgcgttaggatttagaattttttaaaggttggattatattgaaaaagaaatgtttaatttgtaaaaagactttccaagctaaaaccaacagaagtttatattgttcagaagaatgccgcaaaaagggcattcgtgagaaacaacgcaaattgatgaagcaaaaacgagccgataaaaagaaagagaaaattaaggttctaaatactaacgcagatgtgacagaaaagcctaaaaaaatacgtaatttggtacaacactataaaaaactaaagagggaaattttagacaatgagtctgaatttggttttacaggaatcgcgcttgttgagggtatagatattcacgaagaaaactttgtagatttagttatgcaaaaaataaaggagcaacaatgaactatatgggtatgggctatcttcagaggaagttagctctttttaagactggtgtagataaaagatatcgctattatgctatggacgacagagacaacacacgaagtattgtcatgcctgacaatgtgcgtgagatgtacaggtctgtgattgaatggaccgctaaaggagttgatagtctggcagatcgcattatttttagggaattcgctaatgatgattttaatgcttgggaaatttttaaagctaataacccggatatcttttttgatacggctattcaatcggcgctaattgcatcttgttgctttgtgtatattatgccagggaaggaagatagcctgcccaaaatgcaagttattgaagcgagtaaagcaacaggcattcttgacccgactacatttttgctgacagaaggttatgcagtcttagagtcggattcaaatgagaaccctacattagaagcttattttacaggcgaaaaaacctggtactatcccaaagatgagaaaccatatagcattgataactcgacaggacaccctttgcttgtccctgtaattcataggccagatgctgtacgtcccttcggacgtagtcgtataaccaaagctgggatgtatcaccaaaaggccgccaaacgtactttagagcgtgcggaagttactgcagagttttatagtttccctcaaaagtatgttctcggaatggatcctgatgcagaacctatggaaaaatggcgtgctactgtttcgacgttattagagatatcaaaagatgaagatggagacaaaccaacagttgggcaatttacaacagcaagcatggcccctttcatggatcatttaaaaatgtacgcttcattattcgcgggtggctctggacttactcttgatgaccttggtttcccttctgacaatccatcatcagtggaagccattaaagcagcgcatgagaatttaagagcggcaggacgcaaagctcaacgctctttctcttctggttttttaaatgtggcttatattgctgtttgtttgagagatgatttcccttatcttcgtaatcagttcatggatactgaaattaaatgggaacctctttttgaagctgatgcaaatatgctaactttggtcggtgatggtgctattaagcttaatcaagctattcctggtttcatggatgcagacgttattcgggacttaactggtgtaaaaggttctgacaatccaattccaaaagctacggaggtgacaactgatggttgatgatgtcttacctaagctactaaaatctgttcaacaggattttgaaaagcattttggcaaaagtgaggtcgttgctaaggcttttgcagaattgcaagctaaaaaagcgacttataagacagtcaacgagtttgctgtagaggttggacggcttttgtcgttggctctggcaaactctgttatttctgatgagttaccagatggtaaaatgtattataatattgctaatcgtctcgtgaatgatacactgagacataattataagttaatttctgattatgcaggcgatgtccagcaaaatttaaacaaacaggctaaaattagtttaaaaattcaacgtccaccgcttaatcaagataaaattgacgggttagtcaatcgtttggcgagtgaacctgtatttgacgatgtcaagtggcttctcgatgagccaattgttaattttagtcaatctatcgttgatgattgtatcagagctaatgctgatttccactttaaaacgggactgaaaccaactatagaacgtatatcaacaggtaagtgctgcgattggtgtgaccgattagctggtcgctacgtttaccacgaagaaccaaaagatttttacaagaggcatcaacattgtcagtgtgttatcgactatcatcctaaaaacggcaagcgtcagaattcatggtcgaaaaagtggacaaaagaaactactgatatactagaacgacgcaaacagatgaatattgacatcagagacaataaccgtaagtctgatatcaaagaatataaggaaatagtatccattttaggtacaaaagcccctatttctctagctaaattccaagacttgaagtataatgatggtataagatatgagcgattaaaagaccaagcacacatccaaggaaactttaaaaacggaagttggctagataaggtaaatcctgaaaaacaagctcggcatatcaaatcaaccgctggagaaggtaagagttatttcttcgatgatgtggataccgatgttttataccaaaagtataaacagactggtgaattaatcaagaatagaaggggacggactcataaggaacttattgatttaccagaagatatttcgataggtattgatatttactcaggaaatttagtaaatggcctgactattcattacggaaagaccggatcgcacattgttccaacttatcatgaaaggagagagtaatggaattattgcagtacaataataagaaaatttcacttgttgacattgatgatgagatatggactggaacagcatactattgcgatgctgatacaaatgagacccccgaggacgtcttagtcgtaaaaaacgagagaggatatacagaaatttctgaatcagaaatcaaatcaattgaaatcatttaataagcgcttagctagtgttgcaagtgctttttttatgctcgaaacaaggaggtggtttgtctcccagcgagagggttatcatgcagtacgattgaaaggaaaaaagtatggttactaagacgaaagcaaagcttggcaatcagcgacctactcaatcggtaaatttacattttgctaaaactctagctcatgaagccatcaattactacaaaaaaacaggtctaagttgctacttgtggcaagagaatatgctcatacctatgatggctatcaacgaagataacctgtgggtgcatcaaaaatacggctacgctattcctcgacgaaacggaaaaacagaagtcgtttacatacttgagctgtgggctttgcataaaggattgaaaatcttgcatactgctcacagaattagcacttctcactcttcgtttgaaaaagtaaaaaaatatcttgaaatgtcaggatatgttgacggagaagattttatatcaaacaaagccaaagggcaggagcgtattgagtttaaatctagcggttctgttatccagtttaggactaggacatcaaatggaggtcttggtgagggatttgacctactaattattgatgaggcgcaagaatacactgccgagcaagaatcagcgttgaaatacacggtaactgatagcgataacccaatgactattatgtgtggaacgccaccgaccatggtatctactggtacagtctttgaatcttatcgtaaagagtgtttaaaaggtgacagacgctactctggatgggcagaatggtctgttgacgaaatgcaaccaatacatgacgtaaaaagttggtatgttgccaacccgtccatgggataccacttaaatgagcgtaaaattgaagctgaattaggtgaggatgaaattgatcacaatatccagcgcttaggatattggccgtcatttaaccagaaatcagttatatctgaaaaggagtgggctaaactaaaagttgagcaagtaccagaactcaaaagtaagttatttgttgggattaagtttggccaagacggtaacaacgtatcattgtcaattgcagcaagagcatcagaaaataaagtatttgttgaggctattgactgtttatccgttagaaatggaactcaatggattattaactttttgaaatcggctgacattgctaaagttgttgttgatggcgcaagcggtcaagaattacttgctcaagagatgagagagcatggtttaaagaaaccagaattgcctaaagttgctgaaattatcacagctaacacgatgtgggaacaaggtatcatgcaagagactatctgccacaacgaccagccatctttgacagcggtagttacaaactgcgaaaaaaggcaaattggctcgaatggtggttttgggtataaatcgctttatgatgatagagacattagcttaatggacagtgcattgcttgcgcactggatttgttacacaacgaagccaaaaagaaagcaaagaaccagctgttaaaaaacgacatccggaagggtgtttttttactgctaaaaaatctaccgaactgccgggaaagcaggagaaaggacgttaatatgtcagaatttaaagttattgaaacacaagaagagttggacacgattgtgaaagctcgcattgctcgagaacgtgagaagtatcaagattacgaccaactgaaaactcgtgttgaagaactagaaaccgaaaacagcagcttacaaactgctttgaatgatgctaaatcaaacactgatagctatacagagaaaattaccactttggaaaatcaaatcgctggttatgaggcagcaaatttacggacaaaggtagcgttacagtatggcttaccaatcgatttagctaatcgtttgcaaggcgatgatgaagacgggctcaaggtggatgcagaacgcttagcatcttttatcaagccgtctcaaccacaaccgccaacaaagtcaaatgaaccgattattaccgaccaaaaagaagcaggttggattgaaatggcacgtaatttagttaacaaaggagaataaacatggcagaatcaattaaagcaggaacgttatttaaaccagaactagtaacagaaattatgagtaaagtgaaaggtcactctacgcttgcgaaattatctggtcaaacaccaatcccgttcaacggagtagaacaatttgttttcaacttggatggtaatgctcagattgttggtgaaggtgagcaaaaattagggaataccgcaaaggtcacttctaaaattattaaaccgctgaagtttgtttatcaggcacgtatgactgacgaatttaagtacgcctcagaagaaaaacgattgaatttcttaaaacattatgctgacggttttgctaaaaaaatggcggaggcttttgatattgcagctattcatggccttgaacctcgcacaatgacagatgcctcattcaaagctacaaactcatttgatggggtcgtgactggtaatgtcatcaaatacgaagcagataaaattgacgacaatattgatgcagctgttacaacgattgtagcaaatggaaatgatgtgacaggtatcgctttgtcaccacaggcaggacaagatatgtctaaacgaaaagataaatttgataatgtgatgtatcctgaatttcgattcgggcaacgtccaagcaacttctttaatatgactttagacatcaacaagacacttactatgaaaggtggcacagctaaagatgaccatgctattgtcggagatttccagaatatgttcaagtggggttatgctgaaaatatcccaatggaaatcattgagtatggagacccagatggctctggacgtgatctaaaggcttataatgaaatcctgctccgtacagaagcattcataggatggggaattttagatgagaaagcattctctcgcgttgaggtacaaggatgatttatagagacaaaaacacaggagcagtagtcgttactgactgtgcgctgttaggcgactgggagattgttcctaacacagtagataagacaccgacaagtgatgaaaaatcttggaccgttcaaactctgaaagaacatttgacagggctaggaattgagtataactcgtctgctacaaaatctgagttattagaattactccctaaataagaaagggaagtttatgacaaattttgcgacaacagatgacgtcattttattatggcgtcaattatccgttgacgaaatcaagcgtgctgaggctttgttagagactgtctctgacacgttgaggttagaagcaagtaaagtgggtaagaatctagatgaaatgattttggaaactccttactttgctactgtattgaaatcggtaactgtagatattgtagcgagaacgctgatgactgctacacaaggtgaaccgatgtcgcaagaaagtcaatcggcacttggctacacttggtctggaacttatttggttccaggaggtggtctttttattaaggatagtgagttgaagcgtctcggactaaaaaaacagcgatatggaggaattgagctttatggggaaattgaaaggaataacagttactttagtcgacaagacgattagcggaaaagaccctttcgggaacccgataaaagttgattttgatattaaaattgagaatgttcttgttgcaccggcaactaccgaagacatcaccaatcagttatctttgaccggaaaaaaagttgaatatatcttggcaattccaaaaggagataagcatgattgggaggataaagaggtttgcttttttgacaaaaagtggcgcactgtcggcctagctcttgaaggtattgaagagcttattccgcttgaatggaataagaaagttatggtggaaagatatgagtaagtttaaattcaagctcaataaagctggtgttgctgaattgatgaaatcatcagaaatgcagcaggtattaaccactaaggccacagccatcagagaacgttgtggcgatggttacgcccaagatatccatgtcgggaaaaatagggctaatgctatggtcagcgctaaaaccataaaggccaagaaagataactcaaaaaacaacacattgttgaaggcggtgcgatgattgattgaagtaattatcaaaaaatatttagacgagcatttagatgtgccgtctttttttgaacatcaaaaagatgaacctgcacgattcatcattttagaaaagactagcggggctaagcaaaatcatttgctaagttccacgtttgcttttcaaagttatgccgaatcgttgtatgaggcggctttacttaatgacaaagtaaagcaagtaattgagcagcttgatgtcttgccacaagtttctggtgtacatcttaacgctgactacaattttacagatacagcaactaagcgctatcgctatcaagctgtatttgacattaatcattattaaggaggaaatatggtagcaaattcatcaaacgttactacggctaaacctaaaattggtggtgctatttatactgcgccgctaggaacagaattacccaaagacacagcatcagagttaaatgaagcttttaagtcattagggtacatttccgaagacggcttatcaaacgaagataaacgagaatcagaagagatccaagcgtggggtggcgatgttgtagaatctgcccaaaaaagtaaagcagataaatttacatatacattgattgaagcattgaatattgaagtactcaaagaaatctatggcaaagataatgtaactggagaccttaaaaccgggattactgttaaatcaaattcaaaaccactagaggaacattgtttggttatcgagatgattttgaaaaacaatacagttaaacgtattgtaataccaaaagggaaagtatccgaagttggtgaaattaagtatgtcgacaacgaagcggctggttatgagacaacgttacaagcgtttcctgatgcggaaggaaacactcactatgaatatataaaaggagctggttaatgaaaacatcgtcaggttttgaatataagattgaagaatcgcgtttaaaaaattatgaattagtagaggcactagcggatttagaaagcaatccgctgtctttaccgaaagttctacgtttgttgctaggtgaccaagtagaaagtttaaaaaatcatttacgcgctagcgacgggactgtttcgacggaggcgttgatggaagaagtgaaagaaatttttgaaagtggtcaattaaaaaaataatagcccttgccacaatgctaaaaatggacgaagatgctcttgtctgtgatttagctgaaacttatcacatatatgattacaaacagctaccacctctaaaagtagctgttttttctttaggcttgagagaagaatcaagaatcaatcgagttatttcaggtaatagagtctcatttgaaagacgaatactagctgggatgtttgacagacttggaatgctcatttggatgaaaacgacagatggccaaaaaggtaaaaatagaccagaaatggtttcaacaatgtttgataatcaacagaaagatagtgaagttgtttcattcggcagtggcaaggatttcgaagaaactagaaataacattcttgggtttggaggtgatagctgatggctactaacttaggacaagcttacgtgcagattatgccgtcggctaaaggaatctctggatctataagtaagacgttagacccagaagcgtcaagcgcaggtagctctgcaggtagcctattaggaggtaaattgattgggatattggggagtgtcattgcagctgctaaaataggcgaaatggtcacaaaagcaatatcgtcatcaatttcagaaggagcggcgcttcagcagtcacttggaggagtagaaacccttttcaaaagcaacgcaaatttagtaaaaaaatatgcagacgaagcctataaaacaactggcttatcagcgaatgcgtatatggaaagtgtcaccggctttagtgctagtttgcttcagtcgctcggaggggatacggccaaagcggcaaaagtcgcaaatatggctatgatagacatggctgataactctaacaagatgggtacatctatggaaagtattcagtacgcttatcaaggttttgcgaagcaaaattacacgatgttggacaatttgaaactcgggtatggcggtacgcaagaagaaatgaaacgtttgctttcagatgcccaaaagctaactggaaaaaaatatgatatttcaaatctctcagatgtatatgaagctattcacgctattcaagggaaaatagggataaccggaacaaccgctaaagaggcagcaacaacgttcacaggttcttttgaagctatgaaagcagcttcgaaaaacttgttggggaaaatggctttaggtgaggatatcaaaccatcgctaaaagcgctgtttgatacaacaagcaactttgtattgaataactttataccaatgctaacaaatgtttttaaaggatttggttcggttatttcgttaactttctcagagctaatacctaaaattgttggttttatgcaaacaagcggtccgtcgctaatgcaatctggcattagctttattattagctttgttaacggatttctaacagcctatcctgcatttttaacagtggcaggaaaaatatttacagatttcgtatcttttgtaatgcaaagtatacctggactcttgcaagctggggctactctcgtcctgaatctaatagatggaatattagctaacttacctcaaatagcaacttcggcagtatctgtgatatcaagctttatatcaatgttgcaagcaaattacccggcaattttaaaaaaaggttttgaaattttaagttacttagtgcaagggattatagcaagattacctgatatcgttattactgttggaaaactcatagcgattttagcaggagcgatagcaagtaatctacctaaagtgctagctcttggagttcagttactcatcacttttgttaaagggattctgagtgtcataggtaaaataaacgaaacagctaacaatattggtgaaaagcttatcaatgcaatcaaatcgattgatttgttgagtgcaggtagagctataatgcgaggtttcttacgaggtttagaggatgtttggggagatattcaaaattttgtcggagatattgcagggtggattaaagatcacaaaggaccaataagttacgatagacgtttacttattccagccggcaacgcaatcatgcaaggtctgcatcaaggacttgttgataaatttaaaccagttaaaaacttagttaacggaatggccgaagaaattcagtcttcattcggaaatcctcaactagcttttgatatggatactaacgtaaacaatggctttgagcgaataggtactttaaataaaaatttatctagtcaagtgactagtacagataattacactagcggcaatgctgctttgttatctgccatcaaaaatttagccgatagacctattgttgtgtctgcgcaatttgataaaaatgaatttgccagagtcgttgctaagccaatagcagcgagacaaaaatttgacgaacagacagaagaaagactgagaggtataaacaggtggtagattacaaaactgtaagatgtcattttggcgatgtcgaattgactaagtggattactattacagacggctttactgtctttagtggcgcagactacgacccggagctaaaagaaattggtggcaaagatggtagcatttttattggaacgaaaactaagcataaagtaataaaagtcccattctgggtaaaatacaatacaatagaagattacgatgccctacaattggctttatcttctaaaaagcctaagatgttgatgtttagccacatacctggacgctattatttagctgtccaggttggggatttgaactttaaagaaatcaagatgaacggctttggtgagataacgtttatagttgcagatgcatatgctcattcaacgtcatacagacgcattaaagactatactcaagacggaaataaaatgaccttcaagattaaaaataacgggacagcccctgcgtttccgatatttagaattaagcacttgggtgaaaatggctatattggaattacaaatgagactggagcatttgcggttggttctcctgaagaagaagacgggactatcgttcatcgtaacgaaaccctttttgattactcaaaagcgattgcacaagctttagaaggtgcgcccaacgtcgcaaaactcaactatatgccaccaacatttgactcggaattaaagcgcatgcgccttgataatattttaggctctggcaaaggtggagagtatgtagctattggtgctagaggaactacaccgggttacggcgagcatgttggaacacggacatttattattaatcctgactcaaacggcgaatatactctcaatgaacacttgtggtggaaacagatttttattgctaccgcgcaggatcaaaaaggatttttaaagctttgcgtgacaggtgaaaatgatgaattcctctatgggattgaaacttacaaacgcaaaaacggctttgaaacagagtataacttttttgctcttgatgatgatggcgttggatggcgcttttataagcagtttgaattccaagcggatagaaattatcacaatcctttttcgatgaatagaagcagggcggttgagatttttagagaagaagataagtttcgtatttactttaacggtgcgcatcatcatgtaactgttccgtcccttaaaggaaaaaaatctcgcaagatacatcttgcgatggggacatgcagtgatagctctaaatatatcaactacaacctgtttgaaaaagtcaattttgaaaaaatgggagtgtctcattacaacaatattgtcaataagtaccaaccaggggatgaggttatcattaactttgaaaatgacactgtaagtacaaaagatatcgattcaatacaagatgtggtgttaggttctaagatgatttcgattccgccaggagagtcagaactagtcgtacacttgtctagctgggtcgcagcgctacctgatatatcaattgattttgaagagaggtacaaataaatgttaacaattcatggaccggatttaaaacctgtcctttttttggataatgataaacaaggagctttgaactactttaaccacaagtggtatagaaagcaaaagactggctcgtctgtactagaattctccgtttacaaaaaagatttgcttggcgatagcccacttagtcataaatatcacgtactaaacgatcaagcatttgtctcttttgtgcacaaaggtaaagtacaattgttaaacatcatgaaaattgatgaagatgaaaaacaaattgattgttattgcgaaaaccttaatttagagttgctaaacgagtattgtaacgcatataaagcaactaaagcgatgtcgtttgaagagtatctcgtgcagtttgacattttgagctggggggctttgacagttggcacaaacgaagttaaggacaaaaaacttacattggaatggactagtcaagaaactaagttagctcgtcttttgtcaattgctaataatttcgatgcagaaattgagtttgagacaaagcttaatttcaatcacacgtttaagcaactcatcattaatatttacaaagaatacgaggagggcaaatcttatggtgtagatcgtgataagaccgacgtgatattacgctatcaaaaaaatatttctgggataaggaaaacagttgacaagcgccagatttataacgctattagaccatacggcaaaaaaactgttagaggcgagcgcgttatttctaatcctgtaactcgtaaagtcactaaaacggttggttcaaatcgcacgtacttaggcggagaccttaaatattatggtcatacaatcaaaaaagctaacgtacaagctattattaactacgcagtgcaatataatattttgccaagtggaatcatcacgcaactttatttagagagtttttggggtgattcgacagttggtaaacgtgacaacaactgggcaggtatgagcggtggagcacagacgcgtccaagtggagtaaaagtcactactgggatggctcgtcctgcaaacgagggtggaacatacatgcactatgcaagtgtagatgactttttaaaagattacacttatcttttagcaaaacaagggatttataatgtcgtcggcaaaaagaatatagcagactatacaaaagggctttttagagctggtggagctaaatatgactatgcagcagcaggatatcaaagctacacaaatttgatgactaatatccgaaatggtatcaataaagtaactggaaatatcctcaatacgattgataagctgtggcagactcctgtaaagcccataaccgccgtaaacgtcgctagaagagccactaaaacaatacaagctattaatgaggctactaagctgaaagggcgcagaatcggttctggacagtgttatgcgctatctgggtggtatgcaaaaaaattggatggcgcttggattgacagctcgattggtggtattagaggtcgtatcggaggcggtatggctgctgccttaatcggcactgattataactggggtgcatatgggtggaaggtagataaatcacctaacgctggaaacttaaaagctggtggtatttataatgtacgagcaaatcgaggcgctcctttttataccacaggctgggggcatacaggtattatcaagagtgtctccaagaccagagttactgttttggagcaaaactttgttggtcgcatgtatgttgtcgaaaactcatatgacattaactctttcgcatctggattacaaacagtatgttaccctcgtgaaatagcgcaaggtatgtctgttaacggcgcaacaacacagcaagtaagtggtgggacacagatatcgtacgaagaagtcgtacaagaggctcagacagaatcatacgaagaagaacaaatcatctatattgacaactctatctacaaagagtggaaagatgaaaacggtaaagtagagtactatctcaaaaatggatttttgtacgcaccactttcaagagaccgctatccatctgttttaaccggtaatgagacacgagacaactggatacgaaaagacatggaagtcgagactgatagtcaagaagtcttgatgtcaacaggtctaaaagacttaaaagcacacgcatatccagcaattacatacgaagttgatggctatgttgacttagaacttggtgatgttgtgcggatacaggacgacggatacgagccaccgctgattttgacagcacgagtagttgagcaagaaatatccataacaaatcccagctctaacaaaactaaattcagcaattttgtcgaaaaagaaagtcagttagcttctgatttaatcagtgatatgttgcgtctatacgatgagtcaattccatacgaaatcaaactagctacttcgaatggtgtcgcttttaaaaatggcactggtgaatctgtcctaactcctagcttgcaaaagaacgggaaagactatgaagcagtttatttttataaaaatggtgactcgctaattgatatcggaccatcgctaatcgttaaagcaagcgactttaaccacgttttaaatataacagttgaggcatatttaaatgaggaacttgtagcaagcacacaaatatcatttacagacactgaagacggtgctgacgggaaagatggcgcaccgggaccacaaggacctcccggtgtaaacggactgcaaggtccaaaaggtgaccaaggcattcaaggtccagctggtgctgacggtaaagcgacttatacgcatatagcatacgcccttgacgagaacggatcaactggctttagtgtatctgataacgttggcaaaacgtacataggtatgtatgttgatgataatatcatagactcaaacgaccctaaaaagtacaagtggaatttgataaaaggcgcagatggtgctagaggtatccaaggtccagctggtgctgacggtaagacaccttactggcatgtagcgtatgcaaacagctcagatgggacagttgactttagcgtgtctgatagtgcaaacaagcgctacattgggcaatatactgactacgatgcaatagattcaagtgaccctaaaaaataccgctggactgacatggttgggacggttgtcgtcgggacaaacaatctgattgatggtacaaaatcattttttgggactgattggtttacttctgcaacgctagaagacgagaacctctctaattgtcctttcacgcttaaaaaatggattagtgggcaaaaagtgtcgcatgcaaaagatatcatggtcgagcaaggtgtaacgtacacttttagtgcttatgttaaacgtgaggtagctgggaatttatatttttatctttatgatatagcagatggttttattactagcgataccccacgagagacaattataaaaaacgttgactctagtctcagacgttttgaaatcacttttacaccaactaagacaggtaggattagaccaaggttcgcgatggtgtcatcggagcaaggtagtttcagctctggtgggtttatgctcgttaggggaaataaaacaggcgactggcaggaatcagaagctgataaagcaagtaatcttgattcaaaagctgatcaagaattaacccaagcacaaattctagctcttgaagaaagaactgctatagcaagagaaaatgcaattgctgaggctatgcagaatacactcagtgaagttgaaactaagtggaagctttggtatgacttaaatacgatagacgaaaagcaaaaagttgcaaacgacatcgctcaattgtttgatcgtacaactgagtttaaacaactattaggtgaggcaagtgcaagatttagctttatcaacaatgaaacgttgattggtgaagagggcgttgctatcggtgacaaaggcggaaaagcaaagttatttctatcaaatgacagcatttcatttgtgacaaatggtgttgctcagatgacattgacaggtgataccttaacaataaaaaatggactgtttacagagcgtatacaaattggaaattttgttgaagaagtctatgacagaaatccattatttaatgttatcagagcaattagaaatagttaggaggtgagacatgggaactgctacatatagtaggtcgtgggggaataacctgacacttgaaatattgtctgcttggaataagccaaatatcgcaagtaatacaagcacagtcaatgtacaagtttttttaaaaatgtctagttatggctatatttcaataggtgaaactagacctttaaaaataacagttgatggtagagctgagaccatcaatgttaatccatcgataaattacggacagagaaaactattatttgctaaagattacattgttaatcataattcagatggaaataaaccactattcaatatttcagcatattatccaataaactttagcaattatggtgaagcgactgcaaatcagtctatctcgctacctaaaattaatagacttagtgtatcaagtgctattagtggtgtgctaggtaatgcagtaactatcacaatcaatagatattcaacgtcatttactcacaatttgaaatatgattttaagggtagtacaggtactatcgcaactggcgttggtactagctatttgtggactataccgccaacgtttgctaatttactgcctaatgaattaactggtacaggtaatctgattgttgagacgatggatggatcagcaaagattggtgagacaaaatatactttatcaataacaatacctaatacagctacttataagccaaaattgtcaagtatcactctatctgatacaaatactttaactagtagcattgttagtggaaacaattttgttaggattataagtaaagttaaagttgattttggctcagctattggaaacaacggttcaacaataacaagttataatgctgaaattgtcgggaaaagtaactcaattatcggtaatggtagcgtatttgataaattggacttttttggttcagcaacaatcagagcaacggtaactgatagcagaggtctaacatcagaaccagttgacacaaaaattaatgtcattgattattttttaccaattgttacaagtgcaaaagtagtcaggtctcagcaaaatcctgacattttacaagtcttgccatttgttaagattgcaccaattatagttggtggaatacaaaaaaaccaactcaaaatgtcggtatctgttgcaccatacaatactggtatctatgcagttgatagtggcgcagctacaaatacctggtcaacaatttcccaaatgtcaggcgcccctttaaatcttggcggcacttatgacaagtcaaaatcatggcttgttaagatttcggtgagtgataacctaatgtcagcaacaccaataatacaaccagttgcaagtgagtttgtacttgtaactaaagcaccttctggtgttgcatttgggaaaatttgggaacatggcattattgatgccaaaggcgatgtttatgttgacggtactatttattgtggcgataaggcgatacagcaaaaaccacttgctttaaataatggtggctcttttagacatgacgacaccgacctaaatagcttgcaagacacaggtttttattgtgtatttagaggtgctaatagaccggctggggcaggtcctgggtacgtaacagttgtaagacatgagacagcaaactatgcttatcaacaattttacgaccgcacaaataaaactatatttacgcgcttgctggaaaacggtgtttggagcggttggagtgagtatgttaaaaaagatagcttacaaacgactggctggataacaattggcaacggttttaaatataagcggaaaggtgatgacatagacttgatgtataattttgcttctaatggattacagagatggtctgttggtaatatgccatctggtttaatacctcaagagttgatgtttgcgataactggatggacacttgctccagacaaatcaatccacttacaaatcaatgcatcgggattgattgagtgtataaatcctggcgcttactcaaatacttacagaggtgtcgtgcactggtcaatataacagtcaatataacaaaggagacgatatgtttacaattaacacaaaattcccacaagttcttgaggataaaagtattatgggagtgactgcaattgtgtcagttgatttaccacacgtgaaaggtaacttaacttttgatttaccacctgagtctgaaaataaatcttttgcagaaacgcttgaaaagtgtgagcagatattttacgacgaaaagtataaagataaagctcagtctgaaaaaatgactgaactaagtacatcaacatcaacaggcacacaaacacttatcaatctgataagtacgctttacgcaaaagaggttttaaaagatgaagatcttattgctattggttagaatttttttacaggaagaagggatagatatgatgattaaattatttgcgattgacttatattatggacgtatggcttggtcaagttttgttaaaaagggattttcagagtttattaataacaaaacaaaagagcaacttgcaattatgtgcgatgaagaattacttgctgaaattttagcaagttagtgaggtagtcggatgacagtagaacaagcagaaagaatcgctcaatcacaatttgtgtgggctattctctttatcttgctttttatgattgtggttggttatctggtgcgaacgtctgataagcgtgagaaaaagctaatggatttccatgaccaatcaaaatcagaatctaacaaacgtgaagagtggctcaaaggtcacttagataaaaatacagaacagttacaggacatttctcagaccattggtgttgtccaaaaggagatgtcttatatgagtgaccgcattggtcgtctagaaaaagaggagaaataagatgaacgaatttataacacaaatcattacagtatcagtaccaatttttggtatcatcgcaggtattctcacgcacaaagtaaaaaaattacttataaaaaaaggtggagaaaaagctgttaaaattgcagaaattgtcgctcgtaatgctgttgaggcagttgaacaaatatctgtggaagttggtattaagggacaagataagctaacagaagctaaaacagctgttattgatggtttatcgcaatataatatcagtttaacagagactcagttagaaacatttatcgaagctgcggttaaacgcatgaatgatgagtggaagaaaggtcaataatatggtaattaatattgagcaagctatcgcatggatggcatctagaaaaggtaaagttacttactcgatggactatcgaaatggtccttcatcttacgattgctctagctctgtctattttgctctacgctcagcaggcgcatcagataatggctgggcagtaaatacagaatatgagcacgattggttgataaaaaacggttatgttcttattgcagaaaatactaattggaatgcgcaaagaggtgatatttttatttggggtaaacgtggggcttcggctggagcttttggacatactggtatgtttgttgatccagacaatattattcactgtaattatggttataactcaattacagtgaataaccatgatgaaatctggggatataatggtcaaccttatgtttacgcttatcgttacgctaggaaacagtcaaatgctaaggttgataatcaatcagttgtatctaaatttgaaaaagagttagacgttaacacaccgctaagtaattcaaatatgccatattacgaagcaacaatttcagaagattattacgttgagtccaagcctgacgtcaatagcactgataaggagttgcttgttgctggtactagagttcgagtttacgaaaaagtaaaaggctgggcaaggataggcgctccacagtctaatcagtgggtagaagatgcttacttaattgatgcaacagatatgtaaaccaacagagcgacataaatgtcggtagcaaaaaattatggaggtaaaactccttaagataagacaaatgccctcgctttgcgggggctgtttttgttatcaatagtgaatgcaacaaaattttttcaacaatatattgtgctaaaaatgtatttttatatataatcatccaatatgttgtggttgcttgaatttataaatttcaagacacgattttgtggcttgacattatttttaaaaaaagtataattatcttaacaagacaaaccccccattcctttataggcagatacgttctgatatggggctttttttatatcgttaggagagttatgaaacaacctttagctttgacatgggaagatcaaattagactacttgaaaaacgtggattaattgttaaagctgatgatgtagagaaaatcaaacatatcagttattatagaattaaagaatttgcaaaaccacttgaaataaagcaacaagatggtgaggagcaggatattttatatgataatattgagtttgcagaagttttggcaagatattatcaggataaaaacttaagaatctatctactgcacgctattgaaaaaattgaagtgtctattaaaacaaaaatttcttttgttttgggggatagatatggggcgttcggatatttaaatttctcttcatgggctaataggaataagtttacaaaatatgatattgaaaaaagacaatttaggattaaaaagaatttattgaatactgtaagaaaatctcaactaactgagttacaaaaatcaattaaccttgatctagatggattcccaacagtgtggcttgctattgatttattgatgtttggtgacatcgtttcaatcttaacaatcatgagtgagaagaacattaaacagatttgtcaatattacagttgtacaccagaagaacttgtttcgtggcttaaatgtttgaatttcataagaaatgtatgtgctcataattcaaatgtactggatattcaaatcacaacaaagcctaaacttcgttcagaatggagaaattatattgatacagtaataattaaacataacgtgactaaaccttctaataagttatccgttattattgctattgtagtctatcttgtaaatactattaattccaaatatcaatggagaaatatacagtctagtttgaaggctctttgtaaagaagatgacagtagggcaaagcttttaggttttaaagattatgattctgttaaagcaatgattaatgggataaagtgtactacttttacaaattcaaaaaaatagaaatttttagcaagaatcgcctgatactagctgttcttgcttttttatttgctaaagaaagatatagatgttataattaataaaaataataaggagacacattatgtcacaagaaaaactaaaatcaaaagttgaacaagcatcaggtagcctaaaagaaggagctggtaagctaactggcgataaagagttagaggcaaaaggttttgtcgaaaaaacaattgctaaaggtaaagaactagcagatgatgctaaagatgctgttgaagaggcagtagatgttgtcaaagaaaaactgaaataaatattaaccgctctctattgagggcggtttttttgtgtgtctagagtttgctttcaattaattgttttaattctaataagtcttcttttgtagcatttttgttaataaaactacgagcagtagatcgttttgatagataggttctatgttctctattgttttctgcccactttttatttgctttttcttgaggtgttaattctttatccatttcaatcatccttgttaataaagtaaaatacaactaaacaaattgcgaaaataatcaaatatttcatatttgtcttagatatgatatactatcagtagtggcaaggggcttgagccccaaactactactagaaccttatttgaatctccgtggccggtttttctttttaggttctttttttattgctgtgattatgcttgctataccaaccaacagagttccgattgaagtaagcaaatcagcaatttctgatattctcatatcttcctcctttctatatataattatagtacatgtactatataaagtcaatacttttttttaaaatatttatctttttgtctatcagaacagaaaaatttaaaattgtctatttttaggattttttatcgaatagatagataggaggataaaatatgttatatatagatgagtttaaagaagcgattgataaaggctatatttcagggaacacagtagcgatagtgcgtaaaaacggaaagatatttgattatgtgttgccgcacgaggaagtgagagatgatgaagttgtgacagttgagagtgtagaagaggtgttgagggaattgaagtgaaagggtgcaaaaaaggggcaaaatagattaaaaatgaaactacattgaactttttactattataaacaaccattaaatcaacgcttggactattatgaactattgtgtacaatagtagtagattccggcaggggacatattcattgcatgtaaatagcggtttagagctattttgccccaaatccgccccaaatttctctgattaagtttatcgttcctatctttttgttcttgtaattgatgtgcgtaaacttctaaagtgatatttaaattctcgtgatctaaaacttgagagatggaaattagatagcttgcaaatgtatgcctgagagagtgcactcgtacctcgcgaccagttatttttcggatagttttattgactgcattatttgaaagtttgtcgaataatctgtcgtttttattttttgtaaattcatgcaaaaaaaataatgtatcattgtcaattggtatatttctgatactacttttgttttttgttggcaggtatctttggttgaaatgataatcccaagttttattaattgataaatatttgttagtgtaatcaatatcattaactgttaaacctaaacattcagcgaagcgcatgccagttttagcgatgaggtataacgctgcatacgattgatgttgtgatttttctttacaaatttttatcaagcgtaagtattcattggtttcaagaaattttatctctatttacgccccttattttttgctttaaccttagtgaataaacaaaaatttttttctatatatccctcgtgaacagccatggatacgcaggcttttacatgtatgttaaaacgctttactgtatcttgcacatgcgtttgactataatgatttatgacttgttgatatttagtggaagtaatattgcaaagtaatatatttcctattatatgtttatacgatattcgatattcccacccgttgtcgcgtttacggaaatacgccattgatatactccacattagctaaagaacagggtgttcaaggctaccttgatggaaaaggctctcttagagatatttgtaaatggtatgatatctcaagtcgctctgttctccaaaagtggataaaacggtatactagtggtgaagacttgaaagccactagtagaggatatagccgtatgaaacaaggaaggcaagccacatttgaagaacgtgtagagattgttaactacaccattgcccatgggaaagactatcaagcagctattgagaagtttggtgtttcctaccaacaaatttattcttgggtgcgtaagcttgagaagaatggctcacaaggtttggttgatagacgtgtgaaagggttggagagtaggcctgatttaaccgagattgagcaactttaactcaagattaaacaattggaggaacgtaatcgtctcttagaaatcgaggttagtttactaaaaaagttagaagacatcaaacgaggaaacagacggtaagactaggtaagcatttagcggagttccaagtaatcaagaattattacgatgaggaatctaatgtgcctattcaggccttatgccaactcttgaaggggtctcgttcaggctattacaagtggctcaatcgtcaaaaaacagattttgagacaaaaaatacaaagctaatggctaaaatcaaggaacttcatagactctacaatggtatcttaggttatcgccgtatgacaacatttattaatcgtcaacttgggacaacttaaaacaagaaacggattcgttgattgatgaacattctggggattagttcagtcattcgtcgtgttagccatgcttgtacaaaagctggtgacagattttacgaagaaaatattcttaatcgtgaatttacagccacagctcataaccagaaatggtgcacagatgtcacctatcttcaatacggtctgggagctaaagcttatctcagtgcgattaaagacctgtataacggttctattatcgcttatgagattagtcacaacaatgaaatccacttgttatgaagaccattaaaaaggggctagagctcaatccaggagccacacctatcatccatagcgattgaggtagtcaatatacttccaaagaataccgttatatcatacaacaagctggtctgaccttatccatgtcccggattggcaaatgtattgataatgcaccaactgaaagtttctttgggtttttcaagactgagtcttaccaccttaagaaatacaactcttatgatgagttggtcaatgatgtggcacgttatatcgaattctacaacacacaacgttatcaatcaaaattaaacaacctgactcctctagaattcaggaatcaggttgcataacttatcttttattatttgactgtctacttgacagggagccgttcagattgcttaacctttctaaatttgctaaaatagctacaagaaaacgagccatttaatgcttatttcttatactgtcttgcctcacgctctcctcgaccaaaaattgagcgtgaggctttttgtttcattaaacgatgatatttccatattcatcagtttgttttccgagagccatcaaagcttcgataaggtcgataattccaggaataaaggtaatactaaaaataatatataaaaaaacctggcctatttttcctgcgtaaaatttatgcgctccaatgccgcccaaaagaacgttaataaaacataaactactatgttagcataagactttatttttacaactgaatttcatataaatggattagagtaagggataaaagaaattagcatagctcttttgaaaataaaaaaattaatataatatggaaaaaattttatttcataaacgtttcataaaaggtatgtaatctagtatttaggcaacactattttgtcactggtgtctagtaacttatagattgataattttactagtaaacgtaattcttcgctttaagagttaaatgtctatttattgtaagctaaattgggaggtgaacttatgtaaaattagataggtactgtcaagtacgggatgattattgaaacagccagtatgcatcataaaatctgtattgcttaataactatttccttaaccagacatcagttcattgtttatcatcgctaccctaagtctagttttttcaatagagcattaggtagtttttgataataaaactatataaacatgagaattagatttcgtatcgcattcttcataatgagttatttgagattttcctttgaataaatagatacgaaattcagtaacttcatatataaacggctctatcattgagatagtttgtcaaatgaagaaattttaatggaaatagttttaaaaacattagttgtaggcgatgtaaaaatattaatccagtggatgcaatagttgcggagtaaaaatagagaggagtaattaggaagtgataaaaaatgctatagcatatattaccagaaaaaaaaatagaacacttattatatttgctattttaacaattgttctttcttgcttgtattcatgtttaacaataatgaaatcaagtaatgaaatagaaaaggctttatatgaaagttctaattcttcaatatcaattacaaaaaaagatggtaaatattttaatattaatcaatttaagaatattgaaaaaataaaagaggttgaagaaaaaatatttcaatatgatggattagcaaaattgaaagatcttaaagtagttagtggtgagcaaagtataaatagagaagatttatctgacgaatttaaaaatgttgtttcactagaagctacaagtaatactaaaagaaatcttttatttagtagtggagtatttagttttaaagaaggaaaaaatatagaagaaaatgataagaattcaattcttgttcatgaagaatttgctaaacaaaacaaactaaaattgggtgatgaaattgatcttgaattactagatacggaaaaaagtggaaaaataaaaagtcataaatttaaaattataggaatcttttctggtaaaaaacaggaaacatatacaggattatcatctgattttagcgaaaatatggtttttgtagattattcaactagccaagaaatattaaataaatcagagaataatagaattgcaaataaaattttaatgtattctggtagtttagaatctacagagcttgccttaaacaaattgaaagactttaaaattgataagtcaaagtattctattaagaaagataataaagcattcgaagagtctttagagtcagtgagtggaataaaacatataattaaaataatgacttattcgattatgttaggtggaatagttgttctttcattaatcttgattctatggttaagagaaagaatttatgaaataggtatatttttatctattggaacaactaagatacaaattataaggcaatttatatttgagttaatattcatatcaataccaagtataatatcctccttatttttagggaatctactattaaaagtaattgtagaaggatttattaactcagagaactcaatgattttcggtggaagtttaataaataaaagcagttttatgttaaacataacaacacttgcagaaagttatttaatattaataagtattattgttttatcagttgtaatggcctcttcattaatattatttaagaaaccaaaagaaatattatcaaaaataagttaggagcaaataatggatatattagaaataaagaatgtaaattacagttacgcaaattctaaagaaaaagttttgtcaggagtaaatcaaaaatttgaacttggaaagttttatgcgatagtagggaagtcaggaacaggaaaatccacacttctttccttacttgcaggacttgataaagttcaaacaggaaaaatcttgtttaagaatgaagatatagaaaagaaaggatatagtaatcacagaaaaaataatatatctttggtatttcaaaattataatttaatagattatttatcgccgattgaaaatattagactagtaaataaatcagtagatgagagtatcttgttcgaattaggtttagataaaaaacaaataaaaagaaatgttatgaaattatctggtggtcagcaacaaagggtagctattgctagggcactggtatcagatgccccaataatactagctgatgagcctaccggtaacctagacagtgttactgctggagaaataattaatatattaaaggaattagctcaagatagaaataaatgtgtaatagttgtaacacatagtaaggaagtagcagattctgcggatatcattttagaactaagtggtaaaaagttgaaaaaagtaaataaaatgaatttggaggttgaataatgataaaaaatgcatttgcttatgtaactagaaaaagcttaaaatcattaattattatattagttattctatcaatggcaactttaagcatcattagtttatctattaaagatgccacagatagagcttctaaggaaacatttgctaatataacaaacagtttttctatggaaataaatagacaagtaaatccaggaacacctaggggtggaggaaatgtaaaaggtgaagatattaaaaagatatctcaaacaaacagtatagactcctatgtaaaaagaataaacagcgtcgcagacctagttgatcatgatataattgaaactcaagatacacttgcaaatcaatcacctgaaagagcaaagaattttaagagaacagttatgttaacaggggttaatgactcagcaaaagaaacaaaatttgtatcagaagcatataagttagtagaaggaaagcatttagaaaataaagataaaaataaaattttaatgcataaagatttggcaaaaaaaaacaatctcaaagttggagataaaataaaaataaaatctaatttgtttgatgctgacaatgaaaaagttgcaaatgaaactgtagaagtagaaattaaaggtttatttgatggtcataatagcggtggggtaagtgcagcacaagaactatacgaaaatacactaatcactgacgttcattcagctgctaaagtttatggtaatacagaagatacagccgtataccaagatgcaacattctttgtaaaaggtgataagaatcttgatagtgtaataaaagatcttgggaaactagatataaattggagagaatataatttgattaaaagttcatcaaattatcctgcgctgcaacaatctatatccggtatctattctatttcaaacaaattatttgttggctcattaatatttgcaggagttgtagtttcattattacttttcttatggatgaatgccagaaagaaagaaatagcagtattactatcattaggtatatctaaattagaaatttttggtcaatttataatcgagatggtatttatatccattcccgcacttcttggatcttatttcttagctcaatatacagctgataagctagggaataatatattgaataaagttactggcgatatagctaaacaaatagctagacaatctgcatctagtcaattaggcgggggggcagaagctgaaggattcaacaagactctttcaggtttagatataaatgtattacctaaattcataatttatgtagttatatttatgagttttgtacttcttgtatcattgattctttcttcaatttatacattaagaaagaatccaaaagagttattaattgataataattaaaattttcggtgatttatatcaccgaatgttttttgacttataaaaatcaaataatatactgtataatattatgtatagatttaaatggaggtatctatgaaaatattaactgttgaagatgataagttgataagagagggaataagtgaatacctttcagaatttggatatactgttattcaggctaaagatggaagggaagccttgtcaaaatttaatagtgatataaacttggttatcttagacattcagataccttttataaatggtttagaagtgttgaaagaaattagaaagaaaagcaatttaccaattctaattttgactgcatttagtgatgaagaatataaaattgatgcatttactaatttagtagatggatatgtagaaaaaccattttcattgcctgttttaaaggctagaatagattctttaattaagaagaattttggacatttagagaagtttgaatataagaatctttcggtaaattttaatagttatacagctaaaataaatgatgaaaaaatagatgtaaatgcaaaagaactcgaaatactaaaatgtttattggataatgatggacaagttttaacaagaatgcaaattattgattatgtctggaaggatagcgaagagatcccttatgatcgagtagtagatgtatatataaaagaacttagaaaaaaattacaattagactgtataactactataagaaatgtaggatataaattggagagaaaatgaagaaattaaaaatattcccaaaaatgttcatacaaatattttctattcttggaatactaattatattagttcattcattattcttttttatctttcctaaaacatatttggagacgaggaaagtaaaaatccacattatggcagatgaaatttctaaaaatatgaatggaaaagagttaaaatatttagaccaaactttggagctttattctaaaagtagtgacataaaggtatttataaaaaaaaataataacaaaaatgaattacaaataaatgataatataaatgttaatgtaaaaagtgatagtaattctttaataattgaagaaagggaaattaaacttcatgatggcaaaaaaatacatcttcaatttgtttcaacagctgatatgcaaaaagacgcgaaagacttgagccttaagtttttaccatattctttatcgatatcatttcttttttccattgttatttctttaatttatgctaaatctataaaaaacaatatacaagaaataactatggttactgataaaatgataaaacttgacaaagaaacaagattgaaaattagttctaatgatgaaattggacaactaaaacagcaaatcaatgacttatattgtgctttattgaatacaattaatgatttggaatttaaaaataaggaaattttaaagttagaaaaattgaaatatgatttttttaagggggcgtcccacgaacttaaaactcctctttccagcctaaagatattacttgagaatatgaaatataatatcggaaaatataaagatagagacttttatatcagtgagtgtattaatattgtagataacttaacaaagaatgtctcgcaaatattatctttttattctataaaagacttgaataatgatgaagaatatttaaatgttggtgatacattagatgaagtattagaaaaatactctatcttagtaaatcaaaaaaaaataaatattaataaggaattattagactataatatttatataggaaaaacggcactaaatattgtattttctaatttgattagcaatgcagtaaaatatactaatcgaaatggaataattaatatcaaaatagctaatgattggttacttatagaaaactcatatgataaaaataaaatttcgaaaataaataaaattttagatgctagttttgatctaaaattggataatagtaatggattaggattaaatatagtaaagaatatacttaataagtataatataaagtatgaaatattacatggtgaaaattattttatatttaaaataaaaataatctcttgagtaataatcatactattggactaatgtcaaataagtagacagaaaaccgtgttattttattgcgttaaaataattttcttctttctgattaggggttagtcctagattagccgtatgtgggatgtaattgttataaaaattctcaatgtattcaaagcagtctaattgaacctgtttgatattttgataatttttttggttgatttgtctatgctttaaatacttgaaaaatgcttcagttacggcattatcataaggatatctaggtttagaaaaagaatgcatgatattgttgtcatcaattatttttctaaattccctggccttaaattgtgacccttggtcggaatgaaagagaagtgttccttcaatctttcttttattaagagctaattctagagtgtcacatgctaactttgcatccatacgatgactcaatttccaagcaatatattttctagaatagagatcaattattgcgcagagatagacatatttcttatatccaatagaaatataggtgaagtcagtagaccatacttgattaggtttatcaggattaaatttctggttgagtaagttttgaggatacgttttttgagtctttttaagagctgtttttgtcttaacggtagccattttagggagcgccatattcttcatcagacggtaaattcttccttcagagatttttgtgtcttttaaaacaggttataacacacaaagtgttgtctatttttatagtatacatccatactcgcataaccatgagataatcactaaaacaagagtcgcctgacactagcgactcttgtttttatttgctaaagaaagatatagatgttatgattaataaaaataataaggaggtgcagtatgtcacaagaaaaactaaaatcaaaattagatcaagcaaaaggtggtgctaaagaaggctttggcaaaataaccggtgataaagagttagaagcaaaaggatttatcgaaaaaacaattgctaaaggcaaagaactagcagatgatgctaaagatgctgttgaaggggcagtagatgctgtcaaagaaaaactgaagtaacaaataaccgctcatttaacgagcggttatttgttatctttttgtctatcagaacagatatagatgagtttaaagaagcgattgataaaggctatatttcagggaacacagtagcgatagtgcgtaaaaacggaaagatatttgattatgtgttactacacgaagaagtgagagaagaagaggttgttacagttgagagagtgcttgatgtactgaggaagttatcataataacggaccaaaattcgccccaaaaagtattttaaaatagaataaaataaaaaaatatgctttttattatggatgtatcgtgtattttaacctttaatatatcctattttaatggtagagaagttggcaggggacatattaaaaccttttttgagatgttaggaaggattttattctttagactagtgttgagaaaataacaaaacttaaataatcttatttaagttttgtttaaggtgaactttgtatactttaaatatcctaaataaacttttcttttcatgttctttgttttactgatgaagaacaatctcctaatatttgcaactcataatgatttgagttgcattttttattgcaaaaaatataagtcagattctgaaaaaatgttataataattaccatgaataaaaaaggaagtcctatgtcacaaaaatcaaactattttaaagggcaaattgattatgctgttgtgataccagtattttttttattaatgattggtttagcctcaatttatgttgcaacgatgaatgattatccttctaatatctatatcgcgatgtttcagcaggtgtcttggattattatggggtgtattattgcatttgtcgttatgcttttcagtactgaatttttatggaaagccacgccctatctgtatgctttaggactaaccctaatggttcttcccttaattttttatagtccacagctttttgcggcaacaggtgctaaaaattgggtgaccattggctcggtaactttgtttcaaccgtcagagtttatgaagatttcctatattttaatgttatctcgaataactgttagttttcatcagaaaaatcgcaaaacttttcaagatgattggaagttgctaggattgtttggtttggttacattgccagtgatgattcttctaatgttacaaaaagatttaggaacagcattagttttccttgccattttgtcaggtttaatccttttatcgggcatatcttggtggataatcttgccaattttatctactatcgttctttttatagctagctttttgatgatttttatctcaccaaacggcaaggaatggttttataatttggggatggatacatatcaaatcaaccgtttatctgcttggattgatccatttagttttgcagactcaattgcttatcaacaaacacagggtatggtatcaattggaagtggcggggtaacaggtaaaggttttaatattttagagctctcggttcctgttcgtgaaagtgacatgatttttactgtcattgctgagaattttggcttcattggttcggcgattgttttagggttatatctcattatcatttaccgtatgttaaggatcaccattgaatctaataatcaattttatacttttatatcaactggttttatcatgatgattgttttccatgtttttgaaaatattggtgcagcagttggtatattacctctaacaggaatcccacttccgtttatttcgcaaggtggaagttcattactaagtaatcttattggaattggattggtcttatccatgtcttatcaaaatacagttcgtcaggccaaggctaatggatcacatttgaagtatcgtagtatataacaaaaaaaggttggaaagataatccagccttttaataatcgaaatattttagaggagtgagttaattaagtaaggtggtagctataaaaaatcgtaataatatgatataataaagggtatgaattatcatgattatatttgggatttgggtggtacactacttgataattacgaaagttccacacgtgcttttgtagagactttgaaagaatttggatatcaagcagaccacgatagtgtgtatcaaaaattaaaagagtcaacagcagatgcaattgcatattttatccctgaagaagctgattttttaaaagagtataaggctaatgaagctaaggttttggaaacaccaattctattccaaggggcaaaagaacttttagcgaaaattcaaagacaaggtagtcgtaattttttggtgtctcatcgtgataatcaagttatagttattctggaaaaaacagaaattattgactattttacagaagtagtgactgctgataacggcttttcaaggaaacctagtcccgagagtatgctttatttgaaagaaaaataccaaattgataattgtttagtaataggcgatcgtgatatagataagcaagcaggagaatcggctggttttgataccttattagtcgatgggtcaaaatcattgatggagataatagagtaaatgacagaagaaacaaagaatatggaacaacgtgctcaagaatatgacgcaagtcagattcaagtattagaaggtttagaagctgttcgcatgcgtccaggcatgtatatcggttcgacttcgaaagaagggcttcatcaccttgtatgggaaattgttgataactcaattgatgaagccttagctggatttgcaggacatattaaagtttacattgaaccagataactctattacagttgttgatgatggtcgcggtattccggtagatatccaagaaaaaactggaagaccagctgtagagacagtttttacagttctccatgccggtggtaaatttggtggtggcggatacaaggtttctggtggcttacatggtgtagggtcatctgttgttaatgcattgtcaacacaattagatgtcaaggtttataaaaatggcaaggttcattatcaagaataccaacgcggtgttgttgttaatgatcttgaaattatcggtgatactgacttatcaggaacaacagttcactttacgcctgacccagaaattttcactgaaaccactgtatttgattttgataaattagccaaacgtattcaggaattagcttttttaaatcgtggactaagaatctccatttcagacaagcgagaaggtcaagaagttgaaaaagaatatcactatgaaggtggtataggttcatacgttgagtttatcaatgagaacaaagaagtgatttttgaaaatcctatttatactgacggtgaattagatggtatttcagttgaagtagcaatgcagtatactactggatatcaagagactgttatgagttttgcaaataacatccacactcatgaaggaggaacgcacgaacaaggatttcgtactgccttgacacgtgtgattaatgattacgctaaaaagaataagattctcaaagaaaatgaagataatttaactggagaagatgttcgtgaaggtttaacagcagttatatctgttaaacatccaaatccacaatttgaaggacaaactaaaacaaaacttggaaattctgaagttgttaaaattacaaatcgtctctttagcgaagctttcaatcgattcctattagaaaatccacaagtagctaagaagattgttgaaaaaggaattttggcatctaaagcccgtattgcagcaaaacgggcgcgtgaagtaacacgtaaaaagtcaggcttagagatttcaaacttacctgggaaactggctgattgctcatctaataatgctgagatgaatgaactttttatagtggagggagattctgcgggagggtctgcaaaatcaggacgtaatcgtgagtttcaagcaattttaccgattaggggtaagattctaaacgttgaaaaagctacaatggataaaattttagcaaacgaagaaatccgaagtctcttcacagctatgggaactggatttggtgcagattttgatgtatcaaaagtcagatatcaaaaattagtcattatgactgatgccgatgttgatggagctcacatcagaactttacttttaactctgatttatcgttttatgcgacctgttttggaagcaggatatgtttatatcgctcaaccaccaatctatggtgtcaaagtaggaagtgagattaaagcttatattcagccaggggtcaatcaagaagaggaattacgtcaagctctagatacctatagttcaggacgttcaaaacctactgtacaacgttacaaaggtctaggtgagatggatgaccatcaactttgggaaacaacaatggatcctgaaaaccgcttgatggcacgtgtctcagttgatgatgcagcagaagcagataagattttcgatatgctaatgggagatcgagtagaaccacgacgtgaattcattgaagctaatgctgtttatagtaacttagatatctagtccaaagatagctttgaaaaacagttcaagtatgctataatcttaacgttatagtagatttttagaaaattagaccattataaggagagttgaatgtcgagcggaatcatattgctgcttgtggctatagtcctgcttgtgattattgcctacgtagtcggcgtcgtaataagaaaacgtaatgatacattaattgcaaacttagaaactagaaaacaagagttagttgaccttcctgtgcaagaggagattgagcaagtcaaattgcttcatttgattggccaaagtcaatcaacttttagagaatggaaccaaaaatggactgatttatcaactaattcatttaaagatattgattttcatttagttgaagctgaaaatcttaatgattcatttaattttgtgcgtgctaagcacgagattgataatgttgatagtcagctaactattatagaagaagatattgtttcgattcgtgaagctttagaagttttaaaagagcaagaagagaaaaatagtgcccgtgtaacacatgctttggacctatacgaaacacttcaaaaatcaatttctgaaaaagaagataattacgggacaaccatgccagaaattgaaaagcagttgaaaaatatcgaggctgaattttcacattttgtgaccttaaactcaactggtgacccgattgaagcttctgaagttttgaataaagcagaggagcatacgattgctttagggcaaattacagaacaaattccagctattgttgctaaattagaagacgattttccagatcagttagatgatttggagacaggatatcgtcgtcttttagaggaaaactaccatttccctgaaaaggatattgaacaacgttttcaagaagttcgtgaggctattcgttcgaattcagatggtttagttagtttggatctagatcgtgctcgcgatgaaaatgaacatattcaagaaaaaattgataaactttatgatatttttgaacgtgagattgctgcttataaagtagctcataaggatagtaaaattattcctcaattccttgctcatgcaaaatctaacaatgaacaactggggcatgaaatcaaacgattatctgctaaatatatcttaaatgaaaatgaaagcttaagtttacgttccttcacaaatgatttggaagaaattgaaacaaaggttttaccttctgtagaaaattttggtcaagaagcttcaccttatactcatctacaaattttatttgagcgtacgttgaaaacattgactactgttgaagaaaatcaaatggaagtttttgaagccgttaaaactattgaaagcgttgagacacgagcacgccaaaatatggataagtatgttaacaagctccatatgattaaacgtttcatggaaaaacgcaatcttccaggaatcccgcaagacttcttaagcactttctttacaacaagttctcaaattgaggcacttattaatgaactcagtcgcggtcgtattgatattgaggctgtttcacgtttaaatgatgtgactacaaatgctatcgctaatttagagcaagctacatatctagttgttcaagatgcgactctcacagagcagttactacagtattcaaaccgttatcgtagttttgaacaaaatgtgcaaaagagctttgaacaagctttgtacttatttgaagttgaacataactataaagcatctttcgatgaaatttcatacgcacttgagactgtggaaccaggtgtaactgaccgttttgtgacgtcttatgaaaagacacaagaacgtattcgtttctaaaaaagaagagttagtactcttctttttttaattgctatctatgaaaggtgctaattttaaggtacaatagtaaaaaagttttggaggttttaaatgattaaaggtttgttagtcatggacgttgattcaaccttaataatggaagaagctattgatttattagctattgaagcaggggtggggaaacaggttgctgcactgactgacgctgcaatgcgtggcgagttagattttgaagaagctttgaagaaaagagtagcgctacttaaaggtttgcctgttactattttgacagatatattatcctcaatacattttactccaggggcttatgaattgattaaagagtgtcacaagcgtcagatgaaagttggtcttgtatcaggaggttttcacgagacgattgatatcttagctaagcaattacaagttgattatgtcaaagcgaatcgtcttggtgtcaaaggtggttttctcactggcgaagttgagggagagattgtcactaaagaagtgaaaaaaataaagttaaaagagtgggcttctgaaaatcacttagacctttcacaaaccatcgcaatgggagatggtgccaatgatttaccaatgatcaaatccgctggggtaggaattgctttttgtgcaaaaccaattgtcagagaagaagctgcgtatcagattaatgaaaaaaatttgcttaaggtatttgatattattgatgcaaatgaaaactaggcctttattaagcctagtttttagattaaggattttaagagttttatttgagagggtattaatttgtttttagataaaaataaatcaatatattctggttttaaccagatatagtcaacggtctctccttcttgcaatgtaattatatcttttgcaccattgtattttgcgataaaatggtctacaaagtaagaacgctcagagaaccactctctattaagaaaggttagacattgaggaacgataccagtttcttctttgagttcccttagaatagcttgcttagcattttctcctttaagggcagatccgccagcggtggcttcgaaataagcaggaaaagctttctttttagggtgccgtttcatcatcaatacgtcaccatcctcatgaaaaaggataacatcaacaactaagtggaataagccttgtgggatattttgatccctattaagtgtaagacctgtaatgaacccatattggtcataagcatcccaaatttccattagacctccttgttatttttgactaaagaaatgttgccatagactttttttaggagactcctctttttttggtgaattgaataaatcagggaattgtgtctcaaaatcgttccattcaacgttttcagccttatcactatgtataataataccaaatggagaattggcatttgcttcattaacaatcgtagcagctagtgatagacggttagctaacttcatgtagaacatttgaacatcagtagggagatttggtgataattttaaactaagattaggatattcaagtatcagattattaagagcagatgttatagcaagttgaaacttttcttcttgtgcctcttttaaacttaagtggagcacaactctttctttataagtaccaaggtagtaacgttgttgatcaggatcaagacgattttcaccgcttgctttttgtaggattttattgtcaagttcagtcataatttctccttgaatttgctaattttattataacctaaatgggttgcattagcacaggtaaacttgaaaagaattagtgatttttttatcaaaaaccacgtaataaagcggtttcactgggtttttccttgttattaactaaagattatgatattatgaatatgtaaaatattaaaactcataaggagagtattgtaatgtcaattattactgatgtttacgcacgcgaagtccttgactcacgcggtaacccaacacttgaagtagaagtttatacagaatcaggtgctttcggacgtggtatggttccttcaggagcttctactggtgaacacgaagcagttgaacttcgcgacggcgacaagtctcgttacggtggtcttggaacacaaaaagctgttgacaatgtaaataacgttattgcagaagcaatcattggttatgatgtacgcgaccaacaagctatcgaccgtgctatgatcgctcttgacggaactcctaataaaggtaaattaggtgcaaatgctattcttggtgtttctattgccgtagcacgtgctgcagctgattaccttgaagtaccactttacagctaccttggtggattcaacactaaagttcttccaactccaatgatgaacatcatcaacggtggttctcactcagacgctccaatcgcattccaagaattcatgattatgccagttggtgcaccaactttcaaagaagcacttcgttggggtgctgaagtattccatgctcttaagaaaatccttaaagaacgtggtcttgaaacagctgttggtgatgaaggtggatttgcacctaaatttgaaggtactgaagatggcgtagaaactattcttaaagctattgaagcagctggttacgaagctggcgaaaacggaatcatgattggttttgactgtgcttcatcagagttctacgatgcagaacgtaaagtatacgactacagtaaattcgaaggtgaaggtggagcagttcgtactgctgcagaacaaatcgattaccttgaagagttggttaacaaatacccaatcatcactattgaagatggtatggatgaaaacgactgggatggttggaaagctcttacagaacgccttggtggacgtgtacaattagttggtgacgatttcttcgttacaaatactgattacttagcacgtggtatcaaagaagaagctgctaactcaatccttatcaaagttaaccaaatcggtactttgacagaaactttcgaagctattgaaatggctaaagaagctggttacactgcagttgtatcacaccgttcaggtgaaactgaagattcaacaatcgctgatatcgcagttgcaactaacgctggtcaaattaaaacaggttcattatcacgtactgaccgtattgctaaatacaaccaattacttcgtatcgaagaccaacttggtgaagttgctcaatacaaaggtatcaaatcattctacaacttaaaaaaatagtctcagattattaaacagttgaaaatataataaaaaccatcttgcatatgcaagatggtttttatgtacacattataataatagaattgatttgataataaacagttctaccattgcaatccagcagcagcgatttctgcttttgaagcgtattgtccatttggacgatgccaccttcctctatagtcacgtttgtagccttgactagtttgttcttgtactagagtttcttgttttttctgagtttcagctgcgagccttgcttgctcctctttttgcttcctttgagcttcagcagcaagccttgcttgttcttcttccagttttttctgagtttcagcagcagctttttcctcttcaactttcttttctgcaagtcgtttttcttcttcgtgcttagcgataagttttctttgttctttagctgataagacagtattttgagcctttccgctgaggtagtcaatggtagcatttggtgaggtattctctaaggtaacagtgctgatgccgaattgatcttgagtggatttgtttccgataaaaataggtaataatttcccagtcttatcaataccaacatattttaattcaatttttcttggaattagttcattattttgataaattggtgttactttataatctaagtagtagtttttatgagtcgaaagccaagtctttagttgtttttcatagaatagcatgctctcagggttagatgaattcgtgctattgtagtttccagtatttagccaattcgtcattggaactaaattctttctttcattgtttagtccactaaattggtggcaaataagacggcctcggctcattagccaagctttttgagtaccatcattataatagaatttaaaattgtgccatccaacaggggttgtttttaaacgttttactctctttttcttgggttcatctttaacttttagctgaatatgtgcgaatgtggcacgacctttgtcatccaactctcctaaaaccaattgtcgtttgtgtttaaaaggtaaagtaccattctcttttgttttatactcttgagcagtaacaatattttctgtggtatgatttgtagctaggtttattggtgtgtaaagcgaaataaccgttagtaaggttgcaattcctaattttataaactgttttcttttcatctgttaacctctaaaataacataaaatagtagctgtttatttttaaatgcattctgaaaattaaaatgtgatttttgtaacaatattataacataatgatgtatgacatgtgaagttaatttataaaagatgttacagctatatagaggagctatagtataaataaaaaattcaaaatatagcatatattatgatacaataatagcaaaatagattttgggagttatcatgaaattactgactaatgcaaatactctcaagggaaccatccgtgttcctggcgataaatcaataagtcacagggctattatttttgggagtatatctcagggagttacccgaattgttgatgtcttaagaggcgaggatgttttatcaactatagaggcttttaaacaaatgggggttctaattgaagacgatggcgagataatcactatctatggcaaaggatttgcaggtttaacacaaccgaataatctcttagacatgggaaactctggtacttcaatgcgtctgatagcaggtgtgttagctggtcaagagtttgaagtgacgatggttggagacaatagtttgtcaaagagacctatggatcgtatagcattgcctttaagcaaaatgggagctagaatttcgggagtaactaaccgtgatttaccaccattaaaacttcaaggtacaaaaaaattaaaacctattttttaccatttacccgtagcttctgcacaagtaaaatcagctttaatttttgcggctttacaaactaagggagaatctctcattgtagaaaaagagcaaacaaggaatcatactgaggacatgattcggcaatttggtggacatttggatattaaagataaagaaattcgactcaatggcggtcagagcttagtaggacaagatataagagttcctggtgatatttcgagtgctgccttttggatagtagcgggtcttattattcctaacagtcatattattttagaaaacgtaggtataaacgagacacgaactggaatccttgatgtcgtcagtaaaatgggtggaaaaattaagttatcttcggttgataatcaagtaaaatcagcaacccttacagttgattactctcatctacaagctactcatatttctggggctatgattccacgtctgattgatgaattacctattattgctcttttagcaacacaagctcaaggcaccacagtcatagcagatgctcaggaattaaaggtgaaagagacagatcggattcaggtcgttgtcgaatcgctaaaacagatgggtgctgatattactgctacagcagatggtatgattatacgtggtaatacccctcttcacgctgcttcacttgattgtcatggagatcatagaataggaatgatgatagctattgctgctctcttggtcaaagaaggcgaagtagatttatctggtgaagaagctattaatacaagctatcctaactttttagaacatttggagggattagttaatgcctaaggtattattgggattcatgggagttggcaagactagtgttgccaactgcttagaaaatgaagtaattgatatggatagtctgattgaaaaacatattggtatgtcaatttcccgattttttacagaagaaggagaagcctcctttcgtgctttagaatctcaatttttaaacgaacttttaaagaaaaaaaatgaaggacttgtgatagctagtggaggaggtattgtactccttgaagaaaatcgtcgtcttttaactttaaatcgtcataataatattcttttaacaggaagttttgaagtcttatatcatcgtataaaaaaagatgagaagaatagaagaccattatttttaaaccattcaaaagaagaattttatgatatttatcaaaaacgcatgttactctatagtggtttgtctgatatgattattgataccgattatcttacaccacaaaaaatagctactgtaattggagagtcactggttaatttatctaactaagttatcacagtttggtagtatgaactattattattgaaagtaaatcacctgaaaatatgtcaagaaataattacggtcagctaaatcatcatgaagagctacgatataactatcttttaaaaaacatccattatcttaatgaacgtgaaaagatggaatttcagtaccttcattataaaaaaacagcagtacgaccacagagaaggacagaaagtccaccaactaattcttattatgaggaaccttattctgattcttattatcaagatgacgatttttactcagagcctcagctaacctcacaaggtttaccaatttatcaagaagagagagctccgaagaagaaaaaacaaagggccagaaaagaaaaacagagggtgaaggttatggcgcctttccctccaaaggctataaccccccctagaaagaaaaaaaaatttaagggtttcctaaagttcataggtattatattactaattgttttatcaggtatggttttcatgtttgttaaaggaatgcgtgatgtgaataatgggaagtcacattatagccctgcaattattgaagattttaagggaaaagatgctgttgatgggactaatatcttaattttaggtagtgataaacgtgtcagcgagagatctactgatgcgagaacagataccataatggttgctaatgttggtaacaaggataataaggttaagatggtgagttttatgcgagatctcttagtcaatattcctaattatagtacggaaggttactatgatatgaaattaaatgcgtcttttaatttgggagaacaagataatcataaaggagcagagtatgttcgacaaacgttgaaaaatcattttgatattgatataaaatattatgttatggttgactttgagacatttgcagatgctattgatacactgtttcctaatggtgtcaagattaatgctaaatttggacttgtcggtggacaatctgctgattcagttaaagttcctgatgatttaaggatgaaaaatggcgttgtacctagccaaaaaattaaggttgggattcagtacatggatggaaggacccttctaaattatgctcgtttcagaaaagacgatgatggggactttggtcgaacacaacgtcaacaacaagttatgagagctattgtctctcaaataaaagacccacgtcgtctctttacaggttctgctgctatcggtaaagcctatgctttaacttcaagtaatttatcttatagctttgtcctaacagatggcattccaattttatcagatgctaaaaatggtattaagcaaatgacaattccaagagaaggagattgggtagatgattatgaccagtatggtggtcaagggttaacaattgattttgctaagtacaaaaagatcctaaagaaaatgggactgcgttaacatttttaattatgatataatagagtgatttattgtcactctatttttatctttagtgtataaactaaagacttcaaatgatagatataaaaggaaaattatgttacataaaaatgatattattgaaactgaaattagcgacattagccatgagggaatgggtattgccaaagtagatggctttgttttctttgttgaaaatgctcttccaggtgagattattaagatgcgcgtcttgaaattacgtaagcgtataggatatggaaaagttgaggaatatttaacgacttctcctcaccgaaatgaaggattagactatacctatttacgtacagggattgctgatttgggacatcttacttatgaacaacagctgttatttaaacaaaaacaagtagctgataacctttataaaattgctcatatatctgatgttttagtagaacctactcttggtatgacaatccctttggcatatcgaaataaagctcaggtaccagttcgtcgtgttgatggacagctagagacaggttttttcagaaaaaattcacatactctggtatccattgaagattatttaattcaggaaaaagagattgatgctctgattaattttacacgagatttattaagaaaatttgatgttaaaccatatgacgaagagcagcaatctggtttaattagaaatctcgttgttcgtcgaggacattatacagggcaattaatgttggttttggtgacaacacgtcctaaaatattccgcattgaccaaatgattgaaaagttggtgtctgcctttccttctgttgtttcaattatgcaaaatattaatgatcgtaatagcaacgttatttttgggaaagaatttcgtactctatatggttctgatactattgaggaccaaatgttaggaaatacttacgctatatcagcccaatctttttaccaagttaatactgaaatggctgaaaaactgtaccaaaaagcaatcgatttttcagatttaaactcagaggatatcgttattgatgcctattcaggtataggaacaattggcttatctgttgctaaacaagtaaaacatgtttatggtgttgaagttgttgaaaaagcagtaagtgatgccaaagaaaatgctactcgaaatgggataactaacagtacctatgttgctgattcggctgaaaatgcaatggcaaagtggcttaaagaaggtataaaaccaactgttataatggttgatccaccacgaaaaggattaacggagagttttgtatattctgctgcccaaacaaaagcagataaaatcacttatatttcttgtaattcagcgacaatggcgcgtgatatcaaactatttgaagaattagggtatcatttagtaaaaattcaaccagtagacttattcccaatgacacatcatgtggagtgtgtggctctgctcgtaaaagcctagaaactttttaacgaaaggaatattaaaaagccttagataatcgactgacctattaccaaaaaatcgaaggggctctacttgccattgcacaaacaccaggaaatagtttgccaactatgcagctgttagatgagttagttcttccaaaagacattaccatagcagatgtcagtcaaagtatccaagaatttgaaatagaaagagatgcccttcaagaattttttgacgatatgctgaagacttatacaacctaccaagaaatgaaagattatattaaatctcgtgaagcgaacactcctaagcaagagacagaagaaaaatcactttgaagactgtagacttaacataagtaaaaaataaccatatatgatatcgctttcattcttatgttttttgtgataaactaattaaagaaataatttttatactttattatggaggttcttatgaagaaagtgttagtgagtagtcttttggttttagggattacgataacgttacaaacagtagttgaggctaaggggccaaaagtagcttatacacaagagggaatgactgctctttcggacacaaataaagataaagtcactactatttctattgacgagattcaaaaaagcttagaaggtaagaagccgattactgttagttttgatattgatgatacactgcttttcagtagtcaatattttcaatatggtaaagaatatgtaactcctggatcgtttgattttcttcataaacaaaaattctgggatcttgttgcaaaacgaggagatcaagattccattcccaaagaatatgctaaaaaattaattgctatgcatcaaaaacgaggagataaaattgtttttataacaggtaggacaagagggtcaatgtataaggagggcgaggttgataaaacagctaaagccttagctaaagattttaaattagacaaaccaattgctgtaaattatacaggcgataaacctaaaaagccatacaaatatgataaatcatattatattaagaaatatggttcagacattcattatggagatagtgatgacgatattcatgcagctagggaggccggtgctagaccaattagaattttaagagcacctaattctacaaatctacctttaccagaagctggaggctacggtgaagaggttctcgaaaattcagcttactagtatctttattagttaacatagtattatctatcaatttttagatttgtaataagaagtgctaaaaaagtagcaaatcaatgatatgctaataagggaagttggagtagtttagattgattattaatgactgatcttctcccctctcggtaacaagaagtttttctaacaaatgcctgtctaaaaaaattgaatcataattttttaataactcttttggcgtgaacaaggaatttgtaatcagtcatctaattctataatacaatactttggggttgtttccgtatcattattaataatatgtatcagaaaggagatgttttttgagagtttatgaaaataaagaagagttgaaaaaagaaataagtaaaacatttgagaaatacattatggaatttaataatattccagagaatctaaaagataaaagaattgatgaagttgatagaactccagcagccaacctttcttatcaggttggctggaccaacttggttcttaaatgggaagaagatgaaagaaagggacttcaagtaaaaacaccatcggataaatttaaatggaatcaacttggtgaattatatcagtggttcacagatacctacgctcatttatctctgcaagagttgaaagcaaaattaaatgaaaatattaattctatctatgcaatgattgatttgttgagtgaggaagaattatttgaagcgcatatgagaaagtgggctgatgaagcgactaaaacagcgacttgggaagtgtataagtttattcatgtaaatacggttgcaccttttggaactttcagaactaaaatcagaaaatggaagaagatagtattataaattatatttttaactttaaaaaatttcataaaaatggttaccaaaggcgatagaagaaaaaactatcgtctttttctttataaagtattagatgaggaaaagaaatattattttttctaatacaaatattaaattctcacgacagatgtaatatatcttgctatttcttcaggctcttcagtaaagtcatgatctatccaatttaaaataatactttcaattgttgagatataaataccaagagcgaaagaatatggaacttgatatgctgtttccagttgtttttgtaagtctggtatatcggaatgtgtaatcatctctttgatatagtttttaattatgttgtcaatattcggaaaaaacaaaggatttaataatttctttatttatatacatatagctaagcatctcctttaagaccacttcttcatataataaatcattatttaaaatttttgtgatatcatcaaagattattaaaatagactccctaaggaagtcttcttttgaattgtaatgattatagaaagatcttctactaagtcgagctttttttgctaaatcgctaactttaatttgctcaaagctcctcatctttaacaattctgagaaagcttttaaaaattttaaattagtgttatctgaacttaccaatatactatcacctttatataaaatcttaaagttataaatcttatcgaatgtgattatacaatacaaattcaaataatagttcacatttatcgagataatgtaaaacagtaaaactttaaaaaaagtaaaaatagataactttattggttaatctatttttacttttgaaaaggagagaagttatgcttaggaagtataagcaaagaaattataatgtcgcacatacgaaacagcgtttttcgattaagaaattcaaatttggtgtagcatcggtattaattggattgacatttctaggaatgagtagtcattctgttttggcggatgagtcaagcattatgagtactgaggtaccacaaacagctggtgtaaaaccggaagttactgttacacagcctacttcagatgtaacaagtcttgcgacagatacgtcaacttcagcagtgttatcaacagatgcatctcattctaatcctacagaatcagcggagcatgctgtaggattagaatgagatgcagcggttccagtgacacacgaaaaagaagcaaataaaacattgcgagttacttcttcttccacatctgaattcacagagtggactaatgtcaaataagtagacagaaaaccgtgttattttattgcgttaaaataattttcttctttctgattaggggttagtcctagattagccgtatgtgggatgtaattgttataaaaattctcaatgtattcaaagcagtctaattgaacctgtttgatattttgataatgttttcggttgatttgtctatgctttaaatacttgaaaaatgcttcagttacggcattatcataaggatatccaggtttagaaaaagaatgcatgatattgttgtcatcaattatttttctaaattccctggccttaaattgtgacccttggtcggaatgaaagagaagtgttccttcaatctttcttttattaagagctaattctagagtgttacatgctaactttgcatccatacggtgactcaatttccaagcaatacattttctagaatagagatcaagtattgcgcagagatagacatatttcttatatccaatagaaatataggtgaagtcagtagaccatacttgattaggtttgtcaggataaaatttctggttgagtaagttttgaggatacgttttttgagtctttttaagagctgtttttgtcttaacggtagccattttagggagcgccatattcttcatcagatggtaaattcttccttcagagatttttgtgtcgtagtctctttgaagaatgactttgatagacttcacaccaagtcttttgtttgctttggtataaatctcaagtatttgttttttataaatttgattatccaattctctttttgagggcttatgttttagaaatttatagtaagtggagcgattgacacgtaaaacacgacacaaggttgttgtggcgtgttcaaagcgtaaccgatagacagcgaggagtcttactttaagttttgcatgaatatggcacttgctttttttaggataaggttctcctcttcaagctgcgcattacgtttttgtaactcttgtatttgcttggcagtaagtacagaattatcttcgagtttgaattgagagtactgtttgatccattttgcaagcgcagaagtggataccctatagtctttacagagttcagactgagtttttccagtttgataaaggttaacaagagattgtttgaattcttcatcatagcgtttaaatgttgacataggttgtcctttcgtttttgtgtcttttaaaacagattgtaacacacaaagttttgtctacttttatagtatacatccaccctttggcaataccaaaagtttgagcagattagttgagatgtgcaggaagttttgattatcgcaagagagaatcatcaagtgactcatgaacacgtgtcaatcttattgacctgcgttcaagaattgattgtggaagtcaatcaaacacagccactcagtcgtgagtttcgtgaaaagtatatgggttaggaggctgcaattgtttatcgttatcgtaccaatctcaaaaaagtctttctaacagattcagaattgaatcaattaaatgagcggattgctaagagcaattgtcaaaatttctcagtctatgctagaagagttcttcttaatcccaatatgtcatttgtcacgattaacacggattggaaataacatcaatcaaattgcgcgtgctatcaaccaaagccatctaatttctcaggctcagtatcactttcatcgagaagcacgttaagcccaacagcaggggggttgctctgattcggttaagtaataagcaaaatcctcaccaattttcccagtaataagaggcgttgttgaggtatagggattacctgtgccatagtcgatgatggtcacaaaatgaccattccccataaaagggccaaccaaaacttcacctgtgaccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagtcttccgtttaaacgagaaggctctttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaactgagcgtaagtgggaatctgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctcttcgtttaaagccatatagtgctttaccagcgcataacttttagccacatcagtattttcctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatgacttgttggcaactagcctcaaactgtgtttggaaaaaggcatcgatagacacaagaagactacgtatactggtagtaggaaaacaagggacaagctttatataggataagatttcttttttattacgatgagaaaattgttctagaaagcgactggataactgttcttgcctattgatatcagggctatagggataaaatggtccaatagcaataagatattgacagacaggaaaaattaagaatgattcttcaaaaagaccctcataaacagtgatatcttggttataagggatagctaaatgttttaaaaactgatagtaaggcaacagatagtcttcgttaccatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctggctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttttagagtgttctctttttttagtttacggaggaaaaatatatatggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttaggattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaaaaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaagataagattttgagaatataatcgttttttcgtgctacactaacttgtcagggttgcaacagacaaaaaaataatttaggagggattcgttatgcgtacaaagtatataggatatgaaattgttttaaggggtggttattaatatggataagaaaaaggttgtttcaactatcgtatctacagggtttcttatagtttcaatatcaaatttttttagagagctatcacctatactttttctcttgaatattattggatttttctgcttcctattattattttctgccaacataaataaattgttcttaaaacgatagccgttatataggatatggtatgtatgcatttggtgaaattataggtaaaacgaatggaatagtacttactcctcaaagctatcgtgagaggtataaaaggatatcgaggagtcactagatagttggatctcattgaaaaaatttgtttaaagtatctcatataagcataaaacgaggaatcaatcaaaatttcttgattgattccttgttttttggctctttgtcaactgtagtgggttgatgaaaaattatattctggagaaaaccaaattggttttctcctttttgatattcaaagtgatatgaattctctttttaaaatattcaaagtttctaaagctaaatgtttgtgcttgatgattttgatgagattattggttgctcaagtttggtgtttgaataaggcgattcaaggacattgataaccttatctctgtctttaaaaaatgtcctaaaaacagtttaaaagattggagtgacactagagaaagtgttttaaacagggtaaagaaatggtgagcttgcttctcttgaaagtaaagcaggaggagttgatagagtttcataatgttttttatagagaagcgatatcttcttatcttgaaacagaaaattttgagaaggctaaagtgactgaagagaattaccaagtttttttaggaatccgtacttatcagaagagttataactatcaagatcatagtgagaatctaaaaggaaatattgaggtagcaatgataggagttgaaaataatattagcgacgaacatattttttgctagaatatataaaatgtctttgaaataatttagccctgtgttatgatattaaggaggttatttatggtacgtaaatttttaaaatcgctcctatctctctttcttatagcagtaatcgccaccggtatttcagtggcatgtttcttttttattccagaaaataaagggaatattacaccgattttattgcatcgctttatgcgaaaaaataatgttaatggaatgatgattgttagcgataatactggtaaaccgattaccatctcgcatgggattaaccgtggggaagttgaaacggatattgaaaataataaattatttccaatggcttctctccaaaaactcatgacaggaattattatccaaagattaattgatcaagatgtcttgagtgaagacgaccgattgtctcagttctttccccaagtaaaaggtagtaatagtattaccatccaccaattgttgacccatacgagtgggttaagagaaaaaggtgttaaggtgtctccttatctaaaaaatgagagagaacaattacaattttgcttaaaacactataactttgttaataagaaatcgtggtattattctaatatcaactttagtttcctaacaggtatagccactcaagttacgggaaggacctacgctgaacttgttgatgatgtgataaaaaatcctttgcgattagatgatacccaaagttaccaatcagttgttaatcatgacttagttagcccaatgcgaaagaacggcaagttaaataaaattaatatctttaatcaagtatccacagcatatggagctggagattttttcacaactccgctgaacttttgggtgttgatgcggtctttttctaaagggtactttttcccaacggatgaatataccaaacatcaaaatgatgcgatatcacattattatggtgggctttacatgcatggtcgtatagttaattctaatgggacctttttccagtattcaagttttggttatgcagatctaaagacgcatgatacaatggtgctttttatgaataacaaagtctatagtgatgctagtcacgtggcaccaaaagcatttgaatattatcaaaaatttatgttccttaataagattttccacttagtcttttactttgtattttctttctttttaatgcttttaatacgtcattcgtttaggaaaagaaggtataagaaacgtctctaaatcacatgaataaaaaagaaggctaagttggccttcttttttattcaatattaagcagtaacaccatctaagaaaacgtttgcattgaatttttaattgtgctataataaatagctgttaatcattattatagtttaataatctaactgtcgagctgatttaagctataaaaatactgttgagtaaaagaggtattaatatgtcaatgattgaagtttctcaccttcagaaaaattttataaaaaccgttaaagcaccagggttaaaaggagcatttcaatcatttcttcgtcctgaaaaacacacctttgaagctgttaaagatttaacatttgatgtgcctaaaggacaaattctgggatttattggagcgaacggtgcaggaaaatctacaacaattaaaatgttaactgggattttaaaaccaacttcgggcttttgccgtattgatggcaaattgccacaagaaaaccgacaaaattatgttaaggatattggagtcgtttttgggcaacgtacgcagttatggtgggatttagctctacaagaaacctatacagtgttaaaagaaatctatgacgttcctgataaagaatttcgcaaacgcatggcttttttaaatgaggttttggaactaaatgactttataaaggatcctgttagaactttgtctctcggacagcgtatgagagcggatatcgcagcttctttattacataacccaaaggttcttttcttagatgaacccaccattggcttggacgtttcagtgaaagataatatccgacgtgcaatcacacaaattaatcaagaagaagagacaacgattttactaacgacacatgacctcagtgatattgaacaactttgtcatcgtatttttatgattgatagaggacaagaaatatttgatggcacagtttctcagctaaaagagacatttggaaagatgaaaactctttcttttgatttgcgcccaggacaagagcatatcagctctagtttaattggaaagtcggagattaatattaaacgtaatgacttagttttagatattcagtatgatagttctcgctaccaaactgctgacataattcagcagacattagcagatttttctgtacgtgaccttaaaatgacagatgcggatattgaagatatcattcgtcgcttctatagaaatgagctataaggatgaacagaatttggagacgttataaaccttttattagtacaggaatccaaggattaatcacatatcgtgttgatttcatcctttataggataggtgatgtgataggagcatttgttgcattttatctatggaaagcagttttcgattcctcaagtcaatccttaatccaaggttttcagctgtcagatatgattctctatattattatgagttttgtgactaatttattaacaagaactgatagttcatttatgataggtgacgaagtaaaagacggttcaattattatgcgactcttacgtccagttcactttgctgcttcctaccttttcatggagattggttctagatggctcatctttttaagtataggggtaccgtttttgcttgttattacgggggtacgcctcttcttggggactgatttgattcaagctatagtgttagtggtattttatattattagcattattttagcttttttgattaacttcttttttaatatttgttttggcttctcggcatttgtttttaaaaatttatgggggtcaaacctgttaaaaaattcgttagtcgcatttatgtcggggagcttgattcctcttactttttttccgaaaatcgttgctgatattttaggatttttaccattttcatctttaatttacacaccagtaatgattattattggtaaatatgatggcagtcaaattgtgcaagccttacttttacaaatattttggctaatagtaatggtagctttatctcaattaatatggaaaaaagtacagttgcatatcactatccaaggaggttgagatgacaaaatatcagcgaatgcactttatttttattaaacaatacatgaagcaaatcatggagtataaaatagacttttttgtaggcgttttaggagtatttttaacacaagggttaaatcttttatttctgaatgttctttttcaacatatcccttctttagaaggatggacttttcagcaaatagcttttatttatggtttttctctcctcccaaaaggaattgatcaccttttctttgataacttgtgggctcttggtcaaaggcttattcgaaaaggagaatttgataagtatttaaccaggccgatcagtcctttatttcatgtcctagttgaaacctttcaagtagatgcattgggggagttattggttggttttattctgttatctaccacagtatctagtataagctggaccgtgccaaaagtattattatttatatttattatcccctttgcaactttgatttatacctccttgaagattgctacgtcaagtatcgctttttggaccaaacaatctggtgctgttatctatattttttatatgtttaatgactttgctaagtatcctgtcgcaatatataataatctattgcgttggatcattagttttgtcattccatttgcttttacagcttattatcccgctgcttacttcttacaagatagaaatgtctattttaatattggtggggttatcttgatttccttgatttcttttatggtatcactaatactttggcataaaggagtagaagtatatgagagtgcgggttcttgattagtaaggcaagccattaatttttttgagtgtttagaagttttaggcttactaacttagctttgttagtgatgatatactccccttatagtgtctagtgaatttttgtttttttactgtccactataaggggagtatatcaggtgaagagggactattagtgttgagaataatgtccctcatagaacaataattaccatatctttaccaaaataaagttaaaaacgctcttagatgtgctttctaagagcgttttttggtctataaaaggtaagcaaaaagcagatgtcatttatgaaagtgttgacaaagatgaaatactttgttactattttaacataataatgatattttaattagagtgtgaatttataattaatttttataatgtttattttaaatttaaactaatgtttatagcagtgttttactcatgattttgtgaattcaacacttaagtcatgacctcattttaaagagtttcagacgacacagaaaggaagaaaacataagaaaggcaatgcacggcttgtccatagtagtgtttgaagtagatgtttagaaatattttattttccaacagtactgatatcagagcgaagatgattagttgaaggtgataatatgggacgttctaatattttgagtaggtgtgaacaatgttctgataatcaatgtggcttgtataaaacgcggcttaaagacaagttactattagtagtccaactggttggaaatattaggtattctgagtttcttacggaaggtggtgtatatcataagggagaaaccttgttggaagttataaccttaggaatttcttatgaatataaaagttatggggatatcaaagtaatcaagaagtactgtgctgatggcagtgtcgttgattataacatgccaatactattaatggaaaggattgaataatgaaaacagtaataatatatggaggacagggtaatgttcagtcaaaacacctttgtcaactagttaaaactccaaaaggtgaaattcttttttcaaagttacaagcaactgatttagaatcatatcagttaatgatggatgtcattaaccacaaggtaagtttagacaatgttcatgcgtctatgttagcaaattttttatataatgattggctaacaaacgatgaaaaaatagtatctgggataggattttcagctcatagcgccggtattttcaatgtgttatatgctagtggtagtactagttttgaaaacattattcactttattaaacgtcgtgcccaacttatagaaaattgtcatgtgtctgaagagctttggcttttgatggttgaaaacattgatatgtttagtaaggatgttttaaaagaacagtctgagaaagtaaaattagctattattactgatgatagagctggtgtaattgctatggatcaagtcaaccgttctttctttgatgacgtgatgactaacaaaggttatttttataaattaaagcagttaggcgtaaaagcaccatatcatactgattttttaaatgaatctaaagagcagtataaacaattgattgaaagcctagatatttcgcaaaatgatgactatgactatatttttcattgtgatcaattggtagatgaaattttatatcagtggaccaatctctttaactggcgtgcgattaaggaaactatcatagaaaaggatgcggagattattgatatttctcctaataggtttatttctagtcagttgcaaaaaatgaaaaagagggggaggaaacagttatgaaagtagcaatagttactggtggtaccagaggaattggaagggctattacaaaagagttatacaaagaaggttacaaagtcattgctatttataatagcaatgatgctaaggcaagagctttacaagaggagttaccaaaattagacgtttataaatgcaatatttcagatgcaaaagcagtacaaaaattggtgactaaaatttttagagaatatggcggtattgattgtttagttaataatgctggtattgttagagatggctttttcttgatgatgtctaaggaaaaatggatggatgtcattaacataaatattatggggctagttaacatgagtaaagccgtgttaaaaatcatgaaggctaagcgtatacagggaaaggttatcaatatttcttcaactagtggtatagcagggcagatagggcaagcgaactattcagcaacgaaaggcgctatcatttccattactaaaactctagcgaaagaatttgcatcagatggtattacgattaattgtgtaagtccaggattcattgaaacagatatgacaaatgaattgcaaaataaagaagagctaaaagagcatcttattcctctaaaaaggtttggacaacctgaagaggtggcttggctcgtaagctttttagcaagtgagaaggcaaactatattacaggaaaaaatattgtgattgatggaggaatgattaatgattaactgggctgaagaacgtaaaataataaaaacacgtcaagaagtagttgatgaaattaaaggtattttgattgactctttaatgttggatattgataaagatctgattatgaatgatcaaccattatttggtcgtggattagagctagactctattgatgccctagaactgtcaatagggatttcaacaacgtttggtgttgaactaaatgatgatgatatttcaatattatcatcagtaaatagactagcagattttgtgattgaaaatagtgaggatatagatgaccaagctaagtagtgaagaaattataaaaatgttacctcatcgctatccgtttctaatggtggatagagtgcagagttataaaaaaggtatcattgaatgtcgtaagaatattactatcaacgaaccttactttcaaggacattttccacaacgtcctatagttccgggtgttttgatgattgagatggcagctcaatctgcagctttactttatattttagatgcacttgatggtagcctcccctctcttgatgaattaacagcagagaaaatagcagaaaaagtaggttatttagccagtgtgaagaatttcaaattcaagaaaattgttactccaggagaccagctaaacattacatgtaaatctcaatcaaaattggggcatcttttagaaattcaagtcgttattagagatgagaataaaaaagaggttgcctcaggaaggatgttggtatcagaaaatggaaattaaactcaaaaatattggaaaaaaatatggttcttttgaagcattgagagacattaatctcatctttgaagagggaaaattttatggccttcttggacctaatggagctggtaaaacaactttatttaaccttttaattcaaaattttaagcaaacgtcaggcgatattaagtgggaggtggatggaaaacctctatctattaaagatttttatcgtcacattggtattgtcttccaaagtaatcgcttagatgataatttaacggttgaggaaaatctaatttctagaggtgctttgtacggtttatctaaatcacaagtacgtaatcgccttaaagatcttcaaacgtatctagatatcacagcaataaaaaaacaaaaatatggcagtttatcaggaggtcaaaaacgaaaagttgatattgcacgcgccttgctgccacaaccttctctattattattagatgaaccaacgactggtttagaccctcaatctcgtcgcgatttatgggatgctatcgcacaactaaatcaacaatcgcagatgacagttgtactaattactcattatcttgaagaaatgtctgcttgtgatgttttaaatgttcttattgaaggaaacatttattattcgggagatattaaaagctttattgagcaacattccacaacaaacttgaatgtggtattgaaaccagaaaagtcattagaccaactttcgatagctgattttgttaataaatgtcaagtcctttcagaaagggagatagtatttaaggatatttctgttgaggaaatgatgcaggttatctcagacaatcaagataaatctattattgagacatttaatgttgaatattcgaacttagaggcggcgtatctcaacttgcttagagaaaaagaaaggaaaaacaatgtttgaactaatttctagaaatcgtaaagtttacacgcgagatcggttagcgtttttcatgtcttttttatcagttattatcttaattttggtctatcagattttcttgggaaaaattcaattagatgctataaaagcagcattgaggagtaatacagtatccagtgatactattcacatggttaattattggctcattgcaggtttgacgactattatttcaatgactagtacattaggtgcctttggagttatggtgtccgacaaagaaaaaaaattaaatgaagattttaaggtcagtcctatatcaaatatcaaaattgaattgtcctatgctatatttgccgttttatttggtattgtcatgacgatgttctcttgcatctttgctatcggtatttttaacggctttaattccttgctagagtattcagctatggattatttaactattttagggatcgtttccttagggactgttttatctgcggcgatgattttacctattttagcctttattcatactagttcagcttttacgactcttagcacaattgtagggacttttattggttttatttcaggagtatatctctcaattggctcggtaggaaaagcattacaacaggttatgacatggtttccattgactcaaatcaattctcttttgaaacaggtcttaatgaagggttctattgcgaaggtatttgacaaagccaacgaagccactgtctctaactataaagaatcatatggtgttgttttgcgtaatgctgatggagaaaggctgagtaatcactttatgttgatttatatcattgccctcattcttattttattggcaattcattttattattaaaaaggttaaaaaatgaaagatgataataaattaaagatttctgaagcttccttagaagattattctgaagtggttcatttatttaataggaatcatgtttatcaatttccagacggtaggcctttaactgttgatgaccttgatttaacgttaaaagttaaagaagtgacacatttatttttactgaaaaatcatggtgttttgattggaacatcagctttctttaaatttattacctatggttgtttagattggaatagtagctttagtggttttcttttaattgattcgaaaagtcgtagtggacaggcaatcacttatctatataaaactatcttaaagaagataacaaaactgaagttttctaatatctataccgaaatcagtaactacaataaaccctccttagctttatcaaaattgaatggcttcaaagagtatgataagacatatgaagacatactgcattgtcgatcattgcgtagtcacctccctaagatattgaatacgtttcgtatttcgaattattatggtaaaacatacgacatatcaacttttcaaattatggaggaaattgaaaatcccttggaagaggagacagaaattaggaccaaagtctctgatgaagaaatattatttaaagcagaagatagtgcttcacttccttattatttaaaaatgagcttgtttcaaatggaaattgctaagttagataaccgttatgttttacaagttgactttttatcggaacaagtaaagagggttcgggttaaaactggaaaatatcacttggcaaacttaacgagggctcaccctagcctaactttaagtcgttttgccaattattattacattcaagcaactgtggaaaccctttatggtaatatcgatgttcaactggaacgtcgaaaaaagcattatagagatgcaactatttgtcttaagagaacttttcaaggttatgatttacttatctctccaaatggcagccttatttttgaaaagcagaaaagaaagatacttgaagatagttttttgatttttagccaacctttggacaagaaattagttgtaaaagaagaagaaaatcacattacaatcaaatgtttctatcaaggtgctttaattgagaaaatcatgacatttacaagtgacgaagaaatcacttgtgtttataaatgtaatcaaaaggctaaagagatgttcccaaaattattgaaacagactttcaagttacactgccaagagcagttgattagagatagtgaaggttatcttgtgaatgttccaggaagttacccgattgagcatgatgattttcttcgagcagataagtttgaagatagacaattccattattacctcccgaatgaagataaaatgatttcctattctcctcctggcaaagccagcaatcaaatgcaatttagacccttatgtcttattgatacagatagcctttcttttccactgacttatcattttaggatttcacaagcatcatcggaggaggcgttaatcaatctaaaaaaacagccaatatgggacagcaactaccaagcgtcagcaactgaccttttaaaacatatctctaacctaacattagaagaagagaaggattatggcatcaagagaatgatagctaacagaaagcattatcctagtcacaaactggttttagcctataatcagattgttttgcctaagaatgaaattccaagagacagtgaattatattctatttcttttgattatcgaattagaggaaagtttgtccaaatccgccaaggggaacatgtcaaatatgataataaatcctatgttttggaaaatagtcaacaattagtattgtatgtagctagcgatgataaatatatactaatttctgctaaaaatggaatattttattcttacaaagagaacaatcatttaaaaataaggtgcatgtttaaaaggaactcaccttatgctacaaatgtgagcattacagaatatagaaagtgtgaagaaaaatgaatactatttataatacattgagaacagataaaggttataaagtttatgaggggtatttatatgaaattactggtgaagaatgtgaagaagccttagaccttgtgattcctaagaatattgtatttgcagatacagatacttgtggctacacttttttactcaatgaagatggaacagtttatgatgatgtgactttctacaaatttgatgataaatattggttggctagtcataaagctttggattcttatttagacaacatcaattttgactataccgtaacagatatttctgacgagtataaaatgctgcaaattgaaggaagatattcgggagaaattgctcagtcattttatgaatatgatatttcaacacttaattttcgtactttgatagagatgacttataaaggtgagaaaggttatcttgctagatttggtttttctggagaatttggctatcaatttttcctaccatcttctatttttgctacttttgtttcggatgtctgtgaaggtatagcagagtatggggatgaacttgatagatatttaaggtttgaagtgggacaacccattactgatatttatcaacaagaagaatattctttatatgaaataggttattcttggaatctagatttcacaaaggaagaatttagaggtcgcgatagcttgttagagcacatcagatcagcaacagttaaaagtgttggattctcaacgaaggaaaaactcgcttcaggaacaccagtgctatttgatgaccaaattgttggaaagattttttggatagcagacgagaaagactcttcggaaaattacctaggtttgatgattgttaaccaaacatatgctcattcaggagttacttttgtaacagaagatggccaaattttgaaaacacaatcaagcccttattgtatcccagaaagttggaacaaagaatgagcgtatatgttagtggaataggaattatttcttctttgggaaagaattatagcgagcataaacagcatctcttcgacttaaaagaaggaatttctaaacatttatataaaaatcacgactctattttagaatcttatacaggaagcataactagtgacccagaggttcctgagcaatacaaagatgagacacgtaattttaaatttgcttttaccgcttttgaagaggctcttgcttcttcaggtgttaatttaaaagcttatcataatattgctgtgtgtttagggacctcacttgggggaaagagtgctggtcaaaatgccttgtatcaatttgaagaaggagagcgtcaagtagatgctagtttattagaaaaagcatctgtttaccatattgctgatgaattgatggcttatcatgatattgtgggagcttcgtatgttatttcaaccgcctgttctgcaagtaataatgccgtaatattaggaacacaattacttcaagatggcgattgtgatttagctatttgtggtggctgtgatgagttaagtgatatttctttagcaggcttcacatcactaggagctattaatacagaaatggcatgtcagccctattcttctggaaaaggaatcaatttgggtgagggcgctggttttgttgttcttgtcaaagatcagtccttagctaaatatggaaaaattatcggtggtcttattacttcagatggttatcatataacagcacctaagccaacaggtgaaggggcggcacagattgcaaagcagctagtgactcaagcaggtattgactacagtgagattgactatattaacggtcacggtacaggtactcaagctaatgataaaatggaaaaaaatatgtatggtaagtttttcccgacaacgacattgatcagcagtaccaaggggcaaacgggtcatactctaggggctgcaggtattatcgaattgattaattgtttagcggcaatagaggaacagactgtaccagcaactaaaaatgagattgggatagaaggttttccagaaaattttgtctatcatcaaaagagagaatacccaataagaaatgctttaaatttttcgtttgcttttggtggaaataatagtggtgtcttattgtcatctttagattcacctctagaaacattacctgctagagaaaatcttaaaatggctatcttatcatctgttgcttccatttctaagaatgaatcactttctataacctatgaaaaagttgctagtaatttcaacgactttgaagcattacgctttaaaggggctagaccacccaaaactgtcaacccagcacaatttaggaaaatggatgatttttccaaaatggttgccgtaacaacagctcaagcactaatagaaagcaatattaatctaaaaaaacaagatacttcaaaagtaggaattgtatttacaacactttctggaccagttgaggttgttgaaggtattgaaaagcaaatcacaacagaaggatatgcacatgtttctgcttcacgattcccgtttacagtaatgaatgcagcagctggtatgctttctatcatttttaaaataacaggtcctttatctgtcatttcgacaaatagtggagcgcttgatggtatacaatatgccaaggaaatgatgcgtaacgataatctagactatgtgattcttgtttctgctaatcagtggacagacatgagttttatgtggtggcaacaattaaactatgatagtcaaatgtttgtcggttctgattattgttcagcacaagtcctctctcgtcaagcattggataattctcctataatattaggtagtaaacaattaaaatatagccataaaacattcacagatgtgatgactatttttgatgctgcgcttcaaaatttattatcagacttaggactaaccataaaagatatcaaaggtttcgtttggaatgagcggaagaaggcagttagttcagattatgatttcttagcgaacttgtctgagtattataatatgccaaaccttgcttctggtcagtttggattttcatctaatggtgctggtgaagaactggactatactgttaatgaaagtatagaaaagggctattatttagtcctatcttattcgatcttcggtggtatctcttttgctattattgaaaaaaggtgataaaatgagtaaatttttatttgctcctttcatgatgaatttaggagagagccaaagattatcaaaactggctaattgtttatatgaacaaggacatgatattcatatccttggagacaattattatccatttttatttaataatgatgcttatcgctatcaccactgtgtagaagataaatctgtttataatagtaagcgatatgatgctttcttttctctttcaacagactttaattttttatcagaagaagaaattgaacgcatctgttctattgaaagagacttgttacgccaagaaaaatttgatgctgtattgacaggttaccgtctatctattgttacaagttgtcgtttagaaagcataccattaatttggattatttcaggggcaacgcatatcagtgaaattgttgaaaactcagaaggaatattgcctaatgggaagataagtaaagctagtaagcctcaaacaaaggattttatcaaaagagtaatcactacttattcaacaaatgttaaaacgtggaataactatattaaaaaatatggtggcaaaacttttaataatgctttagaattatttactggtgatctaaacttggtaacagattactctttgttttatgaatttgataaagattcgtcctataaaacgataggacctattttgatagataatgtaggtttttcaaaatgcagccaaattaatcaagacaataagactgtactgctcagctttggtacttcatttaaacgagattgggtggaatcttttttaaagacattaccaaggcattatcattatttactgacaagctgtggtgaggctataaacattccaggaagttatattgagatagttgattttattgattttaaaaccatagataaagagatttatttcgctattatacacggtgggcaaggaacagtttatgcgatggctgcacaaggtattccctttataggtatccctttctttaacgaacaattttggaatattaagaagttcagtaaagaaaagtgcgcttatttggtaaagaaacctgatgtaagagagatacgtaaagcaattagctgtcttgaaagagactatgatatctataaaagttatatgataagactaagccaaggaattaaagaagaagcagaggcatctttacaaaaagcggaggcagaaattgaatcctttatcagaaaaagacaaagttaactatattatgatttataaaaataggcagtctacattggagaataatttatctggcgatcggttgatgagatatcaacaagcaaatagacaggtaagcaaagataaactgttaacagggagttattttgtgtaccaatgcttaaaaaagttaggttttaccaataagatttgtcaggaatctttttctagtgttagtagttatttaattggtttgccaaaggggaaaattagttactctaattctggtgactatcatattctaacctatgctcccagtggttcaactggggttgatattgagaaatacaaagatagatcagaacaaacctaccaaaactacctaggagaatcagttagtagtgatatggattctaaattattattttataaggcatggttacaaaaagaaatttcctataaatgtgggaaatctatagatattacctatcaaacaatgatagatggctatatttatggttatgcttttgataatacttttaaagtagaagcggtttacttaaaagaattattaccagataactaactcgcaacatgttgttcctacatatgcatctataaaaagcactttgaagtatttcaagggctttttataataccttgggtagtctttaacaattatggttagagttgatatgataaactgatcatttccacattttatgagaaaatcagaaaatagaggtgtttttttgtgataataattagaaataataaaaactgaaatattttctaatgtaaaaaaagataaaagaacttattgctgaaaacgattttaacttaacatttgccattgacaagtacttagaggagtgctaaaatttcgttagctggttaacaaaccggttaagtaatgtgaggttcttttatgagtgaattcctttcagccaaacctattggtcataatgattcatctaatactattttaagaattatagagaatacgaaatatattcatcactatgatggaaaagttgttgtcgaaattcctcctcaaaaagagcctatcaaagtcttttttatggattcacgtcttcattatttagaattttcagacatatgtcggtatgtaactgttgttttgaaaaatagtaccgttgataatataaccaatttagggccagataatcatattgtttatgacaatggtgatgatatggttgatccgttgccgagtattcagcatggattatttcttaatgatgattaaagatgtagacaaaaatttagaaacgaggaagccatgacattttataaaaagacggacaaatttggatttaggaaaagtaaagtgtgccgcagcctatgcggtgctttattgggtacagtagcagttgttagtctagctacagcaagtacagagattcacgctgatgaagcaacaacctcacctaccactgtaacgaaagtacctcagccagttcaagcagacacaacagctctaaatacctctaagactcacagtacacaagcaactacaactcctgttgaagctaaggagaataaggttgtcaaaagtgaaactgttcaatctgagagccgagtaatgcctagagataaggtagtagaaaggccagaaacagtaaaagctagtgttaactcagacgttagccaacctattacaaccacacccccaacaattaatgaaaaaacagttgagattcctaacttagctcaagatactaagaaggtagctccaaaagtaactgttacaccagaagttgttaatcagccaaagcagttgcctaaatacgagtaagaaaactcagagaaaggcaataagagtacagaagcaactaaggcagttactgtgactaaaccacagggggcggttgctgagaaagctactccggctgtgccaaagcctcaaaaagtaagagtaattgttgaatttaataaggaatctatcttagattatgcgacagaacagaaaaaaacagttgcacagttaaatcaagctgatgttgagaaaaaattacaaagcatcaagcaagagcaagataaagttcttaagaatattgaaaaaagtgttcactttgattcaagcaaagtgaagcgttacgatgctattattaatggtgtcgcacttgatattcaagctcaagaaattgaaaaattaaaaacgattgctgatgttagaagggtctatgtctcacaagaatatgttcagacaaaacctttactatcttcctcagggcaacttattggtttgccagaagtttggaacaactcccagtataaaggtgagggaactgttgttgcagttattgattcaggggttgatttcaaacaccaagcactaaaaatcaaagaaccaaatcgtgctaagtataataaaactagtattgaaaaactgattcatgaaaagaatctcaaaggaaaattctattccgaaaaagtaccttatggttataactattatgactataatgataacctcaaggatagctacggtgtaatgcatggtatgcatgtaacaggtatcgtaggagctaatgatgataatcaaaaattgtatggtgttgcaccaaatgctcaaattttagcgatgaaggtattttcagatgaccaacaaaatcccacaaccttcacagatgtgtggctaaaagctctagacgatgctattttactaaaagctgatgttgttaatatgagtcttggaacacctgctggatttgtacatgaggggaaagactatcctgaacttgaagttattgcaagagcgtgtaaggcaggaatcgtcattgcagtagcagcaggtaatgaaggaaatatcactgacggtaatacttatggtgttaagccgctagcagaaaattatgatacagccttgattgccaacccagccctcgatgataataccttggctgttgcctctatggagaaccttaaaaagcatgctcatgttttgaaatttaaagataaaaaatctggaacagaagttacagaagtcattaatcttcatgttgccccaaacgcttcaaaaactattattggattggctgtagatttgggagcaggagctccttcggaattgtcaaaacattttgatttaagtggtaaaatcgccatgcttgaaattccagaagataataaatctaatggatttttagaaaaagtacaggcgattactaagttaaatccagctgctatcttgctttacaataatgcgaaggttaaagatgatttaggcagtcaattattagttgaatcagaagcagctaaatttaatattgctcgcattaccagaagcacgtataacaatatcaaaaataatagcaataaaattattactattttaacagagcgtcaagctattgataatagtttagcaggacaattatcttcttattcttcttggggacctacaccagacttacgtctaaaacctgagattacagctccaggtggtcatattttctcaactgtggaggataatcaatatgctgataaatcaggaacatcaatggctgcacctcaggtagctggggcagctgcagttttaaaacaatacattacagataaaaaaattcctgttgataatgctgctgattttattaaattactcttgatgaacactgcacagccaattatcaataaacaatcaaaagatggcaaaacaccttactttgtgcgccaacaaggtagcggagcaatgaatcttgccaaagctcttgttacgacagtcgttgcaactgtaacagggactaacgataataatgcagatggtaagttggagttacgtgaattaaaagagaaaaaatttaaagcacgcattctacttcgtaactttggaaaaactaataaaacgtatatcatctcatcagaagcgattgcggacccagttgatgaaaaaggatttcgtacgcaaaattcagaacacctagtatcaaaaaaagctgatgcagttacaaggaaagttactgtagaagcaggtaagacattagctgttgaccttgatgtggattattctgatgcagaggctttaactcgcaataatttcttggaaggttatcttaacttaaaagatactgaaggtgtagccgatttacacttaccatttttaggtttttacggttcatggacagagcaaaaagctattgatgcttttgaaggcatttctgaaattggtaacggtgacaaaaaacgtcgcgttcaattctatgttaataaagaaaccaacaagacctcatcaacctttacaactaacggcatgttgagtcttccaatctataacaatacagtatttttctctcctaatagtcctttctatgacaaagcaggagttcgtattgcagctttgcgtaatatggagtatgttcaatattctattatagatccagataccaataaagaagttcgtgtacttggtagatcacacgacgttagaaaactttatcgcctagattatcgtaatagttttgccatgatgccagattctatttgggatggtaagattaaagattaaattgcaaaaggggataaacaatacatttatcaaattaaagtacagttgaataataaaggtgtcggtggcgatggtgtccaaatttatcaatactatatcaaaatggacaacaataaaccttacttaagtcccaaagataagactactgtagagaagttagaagatcgctggaaaaaaattactttcaaagttcaggatactggcattggtttgaaagacgtttatcttcaatctgttaagtatgttggtggtggcaataataatttagaccttatcacacctccaggatttaaaaaagaagataaaaaagttgaaaaaccaaaattagaccgtccaccaggaattgatttaccagcaccaacttcaatgagaagttttgattattcaaccccaccgggaactaagccaagcaaacccaaagatagtttatcaactcctccaggtttcccagatttaaacacgccgccggatgaagcaccaaaggatagtaaaaaagacgctattgaagataaatcaggagcaattaaatatgctaagtctcttcaacttagctttgttgatggccctattttagctagcaaagtaaatggcaaaatattacaagtcgaatctgatggcaaattagtcattcctagaaatgctttgtcagctaatcaatttgatgacactagtcttaaaatttatcgtaataataatcgcaataaagaaattactatcacaacagattattttgcagatacaaaatatgtcaatatcacagcggttgactatttgagcaatactacttttgagcaattagctactggtgaaacagtagattaccatgccattgtattttcaagctttgctgctattaaagacaagggtggtaagatttatgttaacgataaattgcaagaaacttctcgtatagcgcttaaagataaatctgttaagattggtattgaattaccaaatgatgtcagacatattgatagtttatctgttcgtcgtttgaatgaggttaaaactgttgataatatcttgaaaaatgatgaacaagacattaatctcagcaaaacttaccaattaaaatacaacccgacaaatcgtcgtctagagtttactattaataacattaactcaagttcagaaatcatgaccactttcaaagatggaaagatgccagaattggttgaacaaaaagatgtttctttggatataaacgatatggacatgagtaagtttaaaactattcgacttggacgaaaggattctgaatttaagggacaacttattgcaaaaactggaacagttgaattagatatgtttttcaaacaatctcaagacccagcttcaattattaaaaaaatataccttatccaaaatggtgttccaaatgaattgaaaaaatttgactctagttttggtttaactgaaagtcagatagatggatactatatttataaagatgcaattaaccttaaatttaaattaaccagtggtgcaagtcttaaagttgtttataaagggcaagaagatccatatagtcatcagaaagaagatatgactaaaaaaggtgaacagctcagtcattcaactcaagccaatgaaaatacagcaaaagtaacctttgctaatattgactggtcacattatagtaaggttactgtgaatggaaaagaagttgttaaaggtagtgagttacctttaactaaaggatggacaacatttgtattacataaaacagaaaattcattaaatgttaaaagtttgattatggagacgggtagtgtaagtaagaaagttcaacaacttcctttaagtcctagattatctaaaaataagcatatgagggatatgctacttactatgcaaaaagattcagcgtattacgaaacaagtgacagtctagtccttcgaattaatctcactgcagatactaaacttaattttaatgctgttaaaggagcgagtgctcttactgaaaatatgatgatgagacagtttgcagttgctggaccacaagatgatcctgttagtgaacataaatacccatcagtatttctcttaactcctgccttattggaaactgctagtgaggcaactctaaatggtaaggaaatcacagcatctggtattatcggtcacatcaaggatggtgataaaagcaagcatgttgaagtcaaaatggtgaatgaaaatggagacatgctaggaacccctgttattattcaaggtaaagacttgactaatcgaacaaaaccattaatgagtggacgtagagtactttatgccggtaaacaatatgagttccgggctaaattaccacttagtcgttttaacacttggattagggttgaagtggtaacagaagcaggagagaaagcaagtattgttcgtcgcatgttctttgaccaatcagttccagagcttaacacagcagttgctaaacgtgatttgacttctgatactgctcttatccacatcgttgccaaagatgactctctaaaactaaaattatatcaagatgattcattacttgaatctgttgataaaaccggtctttatagttttagaaatggtgtagaaatcactaaagatatgacagtaccactagaatttggagataatattattaagttatctgctgttgacttatcaaattatcgtcgtaatgagacccttcatatctatagaaaccgttttgatgttaaagcaagccaaatgacagctgacaaaggagctaaagtaactgtggatatgttgatgaagcacttagttgttccagaaatggcaggagcttatacattaacaatcgacgaagctccaaacacaaatgaatcaggaatgttaacaaacgctaaagtatcgattcattatgtaaatggtggtgttgataaagttgatgttccgattaaagtagttgacttagaagctattcgtaaagctgaagaagcacgtaaagctgaagaagcacgtaaagctgaagaagcacgtaaagctgaagagggacataaaacccaagaagcacctatagttgaagaaggctacaaggttaataacgttcatcaaactgatactacagttaaagcgtctgatttaccaaagactaagacagtttccgcagttcatatggctagaacagacaataaacagataacttcacatcagacacatgttgaaaaacaaattaaaaatacattgccatccactggtgacagcaaacgtggttattatatcactggaatggctatcgttatgctgagtgtattatttagtttagctaaaaagtttaaaagcaaatattaatgataaaataaaatctatttagcaacattaattgtgatggataaaaggttttatctcttaaatcaaaagtagtagctcattagctactacttttttgtataagtgtaaaaaagtgaattcttaacaagaatttaacaccctacttgctatactaaaagtgaataagaaagagaggtgtcatttatgcaaagaaaatcctatttaaaatccatgagtgttcttactttaacagcttgtcttatatcaggatatgtggttaaagatattgctatgttacatgcagtatctgccagtgagaagaaagcaaataatgtcagtccgagagaaaatctctacagggctgtcaatgataattggctagccaatacaaaactcaaacaagggcagactagtgttaatagtttttcagaaattgaggataaattaaagcaactgttagtgtctgatatggctaaaatggcctcaggaaagattgaaacaaccaatgatgaacagaaaaaaatggttgcatactataaacaaggtatggactttaaaacaagagataaaaatggtctcaaacctctaaaaccagttttacaaaaacttgaagcagtctcttcaatgaaagactttcaaagtttggcccatgattttgtgatgagtggttttgttttaccatttggtttgactgtggaaaccaatgctcgagataatagccaaaagcaattggtgcttcgtcaagcacccgcattacttgaatcacctgaccaatataagaagggcaataaagaaggtgaggctaaattatcagcttaccgtacttcagcaatggctttgcttaaacaagctggaaaaagtaacattgaagatagaaaactagttaaacaagctatagcatttgatagactcttatcagaaaaaacgcaagttgatcaaagtaaaatcacagctgaaagtgagacagctgcggggcgatataaccctgaaagtatggaaacggttcacaattacgccaaggaatttgactttaaagaattgattgaaaaactagttgggccaacgaataaggcagtcaatgtagaagataaaacttattttaaacaggttaatgatgttataaatagtaaacaattagccaatatgaaagcatggatgatgatttctatgctagttgatcaatcagattttctaggagaacaaaatcgtcaagcagcgagtgcttttaagaatgttgcgtctggtttgactcagattgaatcgaaagaaaaaatgcttacacccaattagaatatacttttggccatattttgggtgattattatggtaagaaatattttggtgaggcagctaaaaaagacgtcgaacatatggctaagaaaatcattaatgtctataaaacacggttaaaaaacaacacttggttatcagaaaatacaaaagcaatggccattaagaaacttgataacatgagattaatgattggctatccagaagattatcctgatctttatcgtcagtaccaatttgatagtaaagcaagcttctttgaaaacaatgataactacagaaaattatcgaacaagaaaacatttgaagaatttaaccagtctaatcaacgtgaacattggcaaatgagtgccaatgctgtaaatgcttataatgatcctaataccaattccatagtctttccagcagcgatttttcaatcaccactctacgataaaactaaaacagttagtcaaaattatggagctatcggagcaattattggtcatgaaatttcacactcatttgatattaatggtatgaaatatgacgagaaagggaatcttcacgattggtggactaaagaagatttaaaacattataagaaaaaaacacaagctatgattgaccaatgggatggccttaaagcagatggcggtaaagttgatggtaaattaactttagcagaaaatattgcagataatggtggtgttatggcatctctagaagctcttaagactgaaaaaatccaaactataaagaattttttgaatcatgggcaagtatttggcgtcaaaaagcaaccaaagaacaaagtaagtcctcaattcagtcagatgttcatgcaccatatgaattgagagctaacatcccagtacgtaatttccaagaattttatgatgcctttggtgttaaaaaaggcgattcaatgtatctaaaaccagaaaaacgtttgacactttggtaaagctatgttttccagacaataaggagaatgcatgaagaatataacaaagctatcaactgttgctttaagcctactactttgtacggcgtgtgctgcatcaaacacgtctacatctaaaacacagtctcatcatcctaaacaaactaaactcacagataagcaaaaagaagaacccaaaaacaaagaagctgctgatcaagagatgcatccccaaggcgctgttgatttgacaaaatataaggcaaaaccggtcaaagattatggtaaaaaaatcgatgttggtgatggcaagaaaatgaacatttatgaaactggtcagggaaaaattccaattgtttttattcctggtcaagctgagatttcgccacgctatgcttataagaatttaattgagcggttaagtaaaaaatataaaatttatacagtagaaccattaggctatggtctcagtgatattcctactaaaccacgtacgctagaaaacattacaaaagaaattcacacaggcctaaataaaattggagttaaaaatttctaccttgcagctcactcacttggcggtatgtattctttaaattatgctaaaaattatccagaagaagtcagaggatttattggtatggataccagtacaccttggatggaaggggaacaaaaaacaaagtatgaccctgaaagtgctaaatgggcaatgaaattaccagatgttgatgataagactaacgaacagtatctgtcaattgcgaaaaaaattaacggcaataagtctcaacgagatgaagatgagcgcttaggtgataatcttggtaaattgaagaatgtaaaattccctaaagggatgccaactaagtattttcttgctgatcaatctgtggagggaatcaagctacgtcaagcagattttaaaggtttgaaaaattgggatcagcagcatattgatttatctgaagatccaaaagatgcttccgttgaaatttttaaaggtagtcacaatattttccaaacacaatatgaacatatggctaaagctattgatggatttatccaatcccatcaaaagtaatcgttgaatgaaatacctaagtcaaggagaaaaaatgaataaaataacgaaattatcaaccgttgccctcgctttgatgctttgcgttggatgttctgccaataaagataatcaaaaaactaaaactgagcagcctaagcaagaaaagtcaatcgctaagcaaaaacaagagagagaagcagaaaaagctatgattgctaaaggtgctattgacctaactaaatataaagcgaaaccaattgaagattacggacaaaaaattgatgtcggtgacggtaaaaaaatgaacatatatacaatgggtcaagggaaaattccgctagtagtcttccctggtcaagctgaaatttcaccacgttatgcttacaaaaacttgcttgatagattagggaaaaaatataaaatttatacggttgaaccgctcggttatgggcttagtgatatgacagataagccacgtacgattgaaaatattaccaaagagattcatacagctcttgaaaaagtcggtgtcaaaaatttctatcttatggctcactcgttaggtggcatatacggtctaaattatgctaagacatattctaacgatgtcaaaggtttcattggcatggatacaagcacaccaaatatggaaggtgatggcacaactggagaatcttcagcttcaaccttaaaatgggcagaatccattccagaagttgataagaaaaccaatgaacaatacttatcaatcggtgctaaaaaatcaggtaataaaacagagcgcgataaagataggcgtgttagtgacaatcttcataaaatggaaaaagttaagttccctaaaggtatgccagctaagtatttcttagctaatgagtcagcagaagatataaaaatgcgtaaaaaaatattccctaagcttaaaagctgggaacaacaacatattgacttatctgaagatccaaaagacgtttctgttgagacactagatgctagccacttgatttatcatacgcaatataaacatatggcgaaggctattgacgagtggattcaatcgcatgaaaaataattattccccccaattattttactaaggagaaaagatgaataaaataacgacattatcaaccatcgccctgactttaatgctttgcgttggatgttctgccaataaagataatcaaaaaactaaaactgaggatcctaagcaagaaaacgtaactgcaaatccgaaggaagacaaggcaacagcagccaagcgaatgaagttaacgaaagaacttgaaaaatataataaaggcacagagagctttattagtaacaaacaatatcaaaaatatatcaaaacacctatcaaagaatatggtcaaaaggttgaagtcaaaggcaagaagatgaatgtctatactgttggagaaggtaaagtaccaattgtctttattcctggtcaagggacggtgactgccaaacatcagtaccataatttgattagtaatttaagtaaaactcataaggttgtggtagttgagccatttggttcaggtttaagtgatgtcattgaccaaccacgaaatctagctaatattacctcagatatccacgaagctttacaaaaagttggtattaccggaaaatatgtaattgcctctcattcaattggtggtgtttatgcccttaaatacatcagtacttatccaaaggaagtgctaggattaataggtttagatacatcaacgccgggtatggaaggtggtaagcaagttgatttcgctgctccagtgttaaaagaattacctaaaattcctaaagtatccgacgatattaatgcacaattttttgctattggacataagatacttaataattctaatatgaaagaagaagcgaagaattcttctaatatgattaacgaaagtgccaactataagattccaaagggaattcctgctatgtatttattagcacgtgaaagtgacttagggcttcaattacgtagtttagatataccaattaaaggcagttggcaagagcaacataaggagttatcagaagatccaaaagaagtctctattcatacactagacggaactcaccaaatttatgatactaaccttaaagaagtaattgattatactaaccaatttatgaaaacatttgagaaataattgtttttagaaacagtgctataaaatcactaattgatagataacgtagaagtcgatagagaatatctaacgacttctatcgttattctagagattattaagatagaaaaaggagggaaaatagtgaacctatggacattaagtttagcttatttgaaacgtcaaaaaatgaaaacagtaaccttgttcttagtttttctaactataggcacatgtttaatcagtctgatgagtattcagcattctttggaaaaaaatatcctaacaaaacaagggaaaagcatttatttaacctccaaagaaaaggcttattggcctgaacaagcatacgaagctttgaaaaaagcaaaaatggttgagtcagtagaggcaagtttaagcattgatgttggtagccgtttaaaatctgtatcaccatataactcttctaaagaagagaatcaagttacattagcaggttatcaaagtacagaagatttacgagcttttcagacaaaagcattggtcttaaagaaaggaagccatttagcggccgataatacaaaacaagtactagttccattgaagttagcacaaaagaatcatttaagtgtgggtaacaaattgagattaggcaaagaaaatgttactattgcaggaatttatgatgcgaatagtgctaagtctaaaaatacttttaatcccaatattgataatacattgattgctcaggcaacattggttaggaagattagtaaacaaaaaggttatcagacggttgcagtgcgcttaagtgataaacgtttagtggatacagttatccaaaacatcaaacaatggccgcttgatttcgggaaattagatgttcaaacagctaaagagttttatggagattcttatcgtaatatcgagacattgcatcgtctagtgggacgaatcattcttattgttagtctcgtggcgatggcaatattagttgtcatgctaacattttggattaataaccgcattaaagagacgggaattttactcgctatcggaaaaactaagtttgaaatcataggtcattatctgatagaagtactgttagtagcaggtgctgccttcacactatctattattggtggtgtctttcttggaaaaacatttgcagctggccttttatcacaagttaatggtggtgtgagttcacaaattgtacaaaatagtagtctaattattgatagaattgataacctcgctgtttctgttggagtaatggatgtctttagactctatgctcagggtgctttaatttgcttatttgcagttgtattatctagttattctattcttaaactacaaccaaagcaaatattgtcacgaatgtcataggaggttaatatgaatttatttaaacgttcctttttatatgttagccgtaaaaagcgtaagagtatcactttattcgtatgtttatggctagttgcttctacattaattagcggtattgcggtaaaaaatgctggtcttactgctaagaagacattttcaaggcaaactggatcaattttgcatatttcatcggatagtactgaccttgttggtgatggttacggatctggagaaatccctgaaaaagcaatagttaacatagcaagtaatccaaatgttaagcgcgttaataataatttgatggcttatgctggactaacctcggaaaaaatggttacacgaccaaatgataaagaacaatataaagaacaagttttacaagttcatggtaatagttactccgatacagatcctaaatacacagcggggatgatttctcttaagggagggtgacatatcacgccgaaagatcagcgagttataattgttcatcaggcttttgcgaagacaaatcatcttaaagttggcgataagttaatgttttcaaaagaccccgttagaaacagtaaggataaaacattagttgaagcaactattgttggcatatataaaggtaaaacggtacaaaaatcaaattacccttatgagatgctagaaaatacagccttttcagatacgcaattgattaaggatttatacggctattctaaaggtaaggccttttatcgccaaacaactgtatatcctaaaaagaatgctgatatagaaactcttaaaagttttatcaaaaaacaatcctattgattggaataaataccaactgacaattacagcaaccttgctaacaagttatgcaaaaagtatagatgtcttgaatcaattaattacttctctacaaggcggcatgttagtagtatctattatcctagtgatgatggctctgctattctggattggtggtagaacccatgagacaggtattttattagctattggtaagtctaaagcaattatcattgtcagtacgcagtagaagtactaatgattgctattccagcctttgctttatcagtacttatcagtcaatttattggtcaaaaattagcagactccttagtgtatcaggcctctagaactgtcagagcagactttatgaaagggtttgggaatatgcagcttggggctgatagtgatacagatatgtttatgcaaacgattaagacgttaaatgtacaagtgaagcctgaggaagtctggttagtaattctagttggtttagcaatcgtcttatttgctattattactactagtttaattattgctcgctacaaaccaaggggaatcttatcaaaactgtcctaaagtgccataagtataccgaccaatagtgacatctatattaacggttaaaatgaatatgctctgctattgaatacatagctcaagaaagagaaatctatgctcgaattaaaaaatattgcttatcgttataaggggaacgacaataaaacattagaaaatatcaattatagttttcagtcaggggtattttatactatattagggaattctggttcagggaaaacaacccttctatccttgatggcaggtcttgattcgcctactgagggacaagtattatttaacaaaaaagatattaaagaagcaggttatgctcagcatcgcaaaaagaatatagctttggtctttcaaaattataaccttttagactatctaaccccattggaaaatgttcagttggtaaaacctactgcagataaacaattattgttggatttaggtttaaaagaagatatgttaacgcgaaatatcttgagattatcaggagggcaacaacaacgtgtagctattgcgagagctttggttgtaggaacaccagctattttacttgatgaacctacggggaatttagattttgacatttcgcgtgatattacgatgcgtcttaaagattttgcgcataaggaaaaacgatgtgttattatggtgacacatagtagagagatcgctcatatggctgatactgctttacaattgataggagataacttaaaagaattatcaaaagaaagtatagcacagtctatattacaacaaaggaatttataataaaaaaatacctccctttcttaaataataaaagaggaggtattttttagaaatggttatttattatcagaaaaggctcgctctgccatttgttgaattttaattgtagagttattctgataaacgacaccattaaccagtgcaccatgcgcatataaacctggcattggaccatattttggagacaaaacttgtgcattttcagttaaaatagtaatccctccttgatcgtcaatttgacaaaattcttgattgatgagcgattttagaagtggattggcttttgtccagtttttagtgtttaactggtaaccagtagcgttaatgacgcgatcgacagatatatgattttgtttttctttttctattgaaaatccttcgtcattttttgtaattgtcttgacgttattgatcagagaaaaagtccctttttgtgcagctttcaaaattactttagcagattcatcaggcataggatttcgcaagttaataatcgcttttccatagagtgctttatactctttcttatctgataatgacatgagtggccaaaggtcagttaaccagacagtgattcgtgaagctaattgttgtaatagatagagttgcttagggtatttaaaggctaacttgagaccatcaattcctggggataaaaaagtttctgttgtatttttccagtttttaaagccaagatgctccaattcgccagacatcaaatcattaaaatcggcaatagtgaaggtttttgaaggatgtgatagaaatgctttaaggttatcattggtaaaaaagtgccaagtaagtggtaaatcattaacaatacggacgctagggaagtagttggttcttgaaaatgctttaacagaagattgtgtattgagtagcaaccattttataacatcaattgcagctagaccagtcccgatgatagcaactgtttttcccttccaattttcctgagccaagtatttgataggataagggtctttgatataatcggtcttcccttccaaatgataaggttctataacaggcagagcaccacaagctaagtgtaattcatcaaatgtgacaggaaaaagcttatcttgaatatagacttgccattgttgctcatctgataaatagtttagtttatccactcttgttttaataaccgtgacagggagtttatctaaaagtaacttagttctttctgaaaggtattgtccgtaaagtgtccttgatacataggttagatttgtgtcatagtaattttcttctaaccaatccatgaagtcagacatatggcgataatcaaatgaaatatcgttgattggggaattgattaaagctgagtcaacgtcttcttgaaaaggaattcctcgtccaaagtggacagtatcatcaaaacaaaaaatagctaactgttttaactctttctcttttttacgagaaagtgctagtagaacagctaaaccactaactcccatacctataataccaattgtttttttcacagaacaagcctccttaccactatcatagcataaattttgatttaagttaggggatgaacaaagctattatttgcagattttctaatttaatgagtaaattaaatttaaagtaatattaaattaatataagattaaataaatgattgacatgcttaaataataggcatatgatatggttgtgacaaaaggagagcaattagctaaaacggatatcaatatggtagacgcttgtttaatgtaattagaaagaggtaaagcttatgaaaagattacataaactgtttataaccgtaattgctacattaggtatgttgggggtaatgacctttggtcttccaacgcagccgcaaaacgtaacgccgatagtacatgctgatgtcaattcatctgttgatacgagccaggaatttcaaaataatttaaaaaatgctattggtaacctaccatttcaatatgttaatggtatttatgaattaaataataatcagacaaatttaaatgctgatgtcaatgttaaagcgtatgttcaaaatacaattgacaatcaacaaagactatcaactgctaatgcaatgcttgatagaaccattcgtcaatatcaaaatcgcagagataccactcttcccgatgcaaattggaaaccattaggttggcatcaagtagctactaatgaccattatggacatgcagtcgacaaggggcatttaattgcctatgctttagctggaaatttcaaaggttgggatgcttccgtgtcaaatcctcaaaatgttgtcacacaaacagctcattccaaccaatcaaatcaaaaaatcaatcgtggacaaaattattatgaaagcttagttcgtaaggcggttgaccaaaacaaacgtgttcgttaccgtgtaactccattgtaccgtaatgatactgatttagttccatttgcaatgcacctagaagctaaatcacaagatggcacattagaatttaatgttgctattccaaacacacaagcatcatacactatggattatgcaacaggagaaataacactaaattaataaaagagcaactaattgctctttttttgttgtcattcttagtgattaatagtgttaaatagaaatttttggatacattacttagtgttccgatatgatttgacaccagaaataaggacaggaattaaggtaacaaatacaattcccaagataataagcgagaagtgctgcttcacaaaaggaatattaccaaagagaaaaccagaacctgttgcaataactgaccaagataatgctgcaatgaaggcgcgtttgataaatacttttggagggagctgactaatacctgctacaaaaggaacaaaggttctgataatagggatatagcgccctaaaatgatggcagcagtaccttttttctcaaaataaagctcagcatctcggatatttttttctttaatgaaacgacgaaagaaaggatgtttgataaaacggtaaccaaatgtacgaccaatcaagaagttgcaactatcaccaataaatgctgcaataaagaaaataataagaaaagttacaatattgaaggacatttttggatttgcagcaagggctccagcagcaaataataaactatcacctggtaaaaatggaaagatgacagccccagtttcaacgaaaataacgaggaagagcaatagataggtccaattaccaacagtgttagccatagcatagatatgagtatcaatatgtaaaataaaatcgattaaaaacataggagtctcctttattgatcaactaaagtgcagagacttggatgataactatcttgtttataaggcctcttacaaagcctattttatcagaaaatttttaataagaggtaaaataagtttacttattaatttagaattattctaaagagcttttttttgatttttatgttagacttaattataatgattataaataagaaataaaggagcttaacaatgtcctatttaacctttaaacacgttgattttaaaacggatgataagttggttttaaatgatatcaactttgcaattgatgaaggtgattttgtttctattgtagggccatctggaagtggtaagagtactgtattaaaattagccagtggtttaatgagtcctactgcaggtcatattttctttgatggaaaagatttgaaccaattagaaccgattgaaagtcgaaaaatgatttcttactgttttcaaacgccacatttatttggtaatacagtggaagacaatattagttttccttaccacattcgacacgaaaaagtagattatagacgcgttgatgatttatttcaacgttttgaaatggaccagtcttacctgaaacaggatgtcaaaaaactatcaggaggagaaaagcaacgtattgctctgattaggcaattattgtttgaacctaaagttttactcttagatgaagttacttcggctttagacaatcataataaagctattgttgaaaaggttattaaatcattacatgacaaaggaataacgattttgtggattacgcatgatgaggaacagagtcgtcgatttgccaataaagtcttaaaagttgtcaatggtagtattgaagcaatggaggttataaaatgagcggtgaaaattctatttctttaatgtcattactaatggcatcgtcattagttttgattactttatttttttcttactggcaaaagttaaacctagaaaaagaagtgattattagcgctatccgagcagtgattcaattattagcagtgggttttttgctagactatatatttggttatcaaaatcctattttcacagctcttttaatgctattcatgattattaatgcttcttataacgcagctaagcgtggtaaagggattaataaagggtttgttatttcatttatagctattgggtcagggactataatcactttatctgtcttgattttttcaggaattttaaaatttgttccgaatcaaatgattcctgtaggtggtatgattattagtaattctatggtagcaatcggtttgtgctataaacaattattgtccgaatttagaagtaaacaagaggaagtggagacaaaattagctttaggagcagatattttgccagcttcgattgatattattcgtgatgttatcaaaactggtatggtacctacaattgattcagctaaaacacttgggattgtatctttgccagggatgatgacagggttaattcttgctggaacttcacctatccaagcggttaaataccaaatgatggtgacgtttatgctattagcaacgacttcgatagcttcttttgtagctacttatttggcttataaaattttctttaataatcgtaagcaattagtagtaacaaaagattgattcattttaataaacagtatgttagtctggtaagtatagtccaggcttttttggtatcttaatcttatttttgatcgaaaattgaccaagttattgagtcgattacgtttaaatgctactatttaatagaaattgttgtagggattatcaaaaggaggaagaaatgattttaaaaatttgtcgtgcagcatatagtttacaatggggaggtgtttaccaattagctttgctggattatcctcgaattaaggcgtttgaattggaaaggataggagctttcatagcttacgagaaacaatataaaagaaaaactgagatacaatgtgacgataaacatctcctcgcaaaaattgttcattttttaaaatacaatagttttacttttccctatattcccaaatatagagaagcggcagctacttttaatgaggatggtattagtttaacttctgattttttaagccatacatgtacgattgaaactgcaaaactaatttttaaagaaggtaaaatcttatcagcagttaaagcctttaataagcctgctgaagtactggtaaaagataagaggaatgctgctggagaccctaaagattactttgactatgtgatgttgaactggtcaaataccaattctggttatcgtttagtaatggaaagattgttaggcaaagcaccatctgaacaggagttaacagtaggttttaagccaggggtcagttttcattttacttatcaagatatcatcaatcatcctgattctatttttgatggttatcatcctgctaaaattaaaaatcagctttctttagcagaacatttagttgcatgtgttatcccaaaacattatcaagaagattatcaaagccttgtgcccaatgacttgaaacacagggtttattatttagattactgtaacgaaacactttatgagtggaatcaaaaagtttatgattttctttgtcatttggaaaataaataaaaccaaaaagtttaaaactttttggtttaactgctattaattggtctttaaaagacttaaaaattcttcaatcataggactaaaagaagtatcatttcggtaagcaataccaatcggataaaaattatttttatccttaagtgggacccagcataaatcttgaacttggctaatgctttcaaattcacttggtaaaatagtgactgcattgaggtcttgtaaactatgaataagaacttcccagtcattgtgtttaaagacgatatgggggtcaaatcctaaagcacgacatttacgaggcaacatctctcctagcatataatgttcgttgagtgaggcaactttataatctcttaaatcattaagttcaatttcaggaagtgttgcaagaggatgcgattttggcatgacaatgcttactttatatcctttagttgaggtttgcagtggttcgatagtgatatcattgcgggtacttggaaaggacaataagccaatatcgatctttccttttgctaacaattcttgtaatttacgggaaccatcttgaatcaaagatacttcaacatttgaatgtgtagccataaaagttgaaatctgtttcataaattgaatagcaaaaagagaagtaagccctacacggataccttcctttttttcttgatttaattgctggatctccgtaaccatttgattaacattagtcatcaacaattgtcctttctcatagagaatttctcctgcttcagttaaagcgagttgacgaccattttgtaagaataaaatagtatttaattctgcttctaattttttaatggattgtgaaagtgtaggttgggtcacaaaaagactttttgcagcgcgtgaataattttttgcttctgcaacagcaataaagtaagtaagttgtctaatatccataatatctgtccttttttcttagtaatagtatagcacaagtctatcaatctgacctttatgattatttccacaataatattagtaaaagctatacttatataattttttccaattttccttttgcaaatagctatgatatagttaatatagttagtgaaatcacaaacaatcattattagtaggaggcatcttatgtcggatgttgtcgaaaaacaaacaactaaatcgtttataatgaacgtattaaatggtttagctttagggactgttattgtcttgataccaggagcaatccttggagaattaatgaaagctttactgccaatgtggagcggctttgcaactttaatcgctgcaacagcagttgcaacaagtatgatggggcttgttattggtattatggttggtctcaattttaaatttaatcccattcaatcagcatcactaggattagcggttatgtttgcaggtggagctgcaaccttccttaaaggcgctattatgctaaaaggaacaggcgatatcattaacatgggaattactgctgccttaggtgtccttttgatccaatttttatctgacaagacgaaatcattcactttgattgtcattccaacagtaacactcttactagttggaggagtaggtcatgtgttattaccttatgtcaaaatgattaccaccatgattggacaagggacacgccgtacgcatgaaaactttctcttcatccttttgtgcccggacatcaattttgaaaagattcctttttaaatcaatgatctgcttagcctctttctccaaataattggactaaataatcttccaaatggacagaaatataccgttgtttgcgacgataactgaggtcttttttaggaaataccatcactttgagaaaatataagcacatttttcggataagatttaggttaaatgcggctcttttatccaatgtctgatgatgatcttcatgataaacaacgtccaataaccagtgcatactctctatctgccaatgacctcgtacacaattggcaaatgtgaggacatccggcttaaagctaaagataaaataacgattctcttgactcagctgaccatccttatcaatcgtgttacgagtcatcccaataccacgtaacttatgccatttgggatggttttgacacaaccatttgatatcggaagacacccagtattctctaacttcaatctgtcccctagatttttcaacagtctgataatactgcgcattttcttggagttcttccaataagttgacatcactaaaataaagagcaatatcatcataaagtgtttcttgatttcctttgacggctaagcaatagtctgctttaccttttataatcgtatcaacgatagccgtctgcgtgcccattgcgtctatcgttacaatgcttttacggatatcaattgtccgcaataactgaggaatggcaacaatttcattacttttctcctcaaccgctacctgtcccaaactaagatgatgacccccatcataagccgttacaatatgaacaggcttctgatttttacctcgattgcctcgaatcgttttaccgtccactgaaatcagttgatgaacggcatctaagcttgtcaatgattgctcaaattgaactttaagctcttttaaacggtctgaattaacaagactaatcacacgctctaaggtatcatgagacggacaaccttcactcaaatcaacgtaggtcgcaaacaatggttcattcatttcaataaaatcttccatctccttccaggtttcaatgccagctaactgacaaacaaagacaagaaatagaatggttgataaggggtagcgaattttccaagattgacgactatccaattcaactgcgcaatcatcaatagaaataataaaatcaatcatcgtagtcacctcatctatagtgtactactttgattgattttgtcattatgaatctagttttctgaaaacaaaagtttcttcatgcgtttggcgtggacaagggattgcttcattacttggtttacaacctgttttgatgtcaattttaattgcgatgattttctgtttcttgatcgtatctccaatcacaacagttgggattgctttggcaattagtttgtccggaattggttctggtgctgctaatttaggtatctgtgctgctagttttgggctttgtatggctgggtggtcagtcaattctaaggggacagccttagcgcatgttttagggtctcctaagatttcgatggctaatgtattagcaaaaccgaagattatgctacctatgatatcttcagcagcaatactaggaattctcggagctctctttaatattcaaggaacaccagctagtgcaggttttggtatcagtggtttgattggaccgattaatgctcttaatttagcaaaaggtggatggtcagttatgaatatgttattgataattataatatttgttgctgcaccaattatattgaattttatttttaattacctctttataaaagtacttaaaattattgatccaatggactataaattagatatttaaggagatattagtgatgaaactcaaagtatttaatgttagagaagaagaagcaacattagcacaagattgggcaaaccgaaatcatgtggaactttctatgagtgaaggacctttgacattggaaactgttaatgaggtagaaggttttgatgggattgctaatgcacagattgagcctttagatgatgctatttatcctcttctcaaagaaatgggaattaagcaaatcgctcagcgcagtgctggtgttgatatgtataatcttgagttagctaagcaacatggtattatcattagcaatgtgccaagttactcaccggagtctattgcagaatttacagtgacaatcgctcttaaccttattcgaaaagttgagcttattagagctaatgttcgtgaacagaatttttcatggaccttgccaattcgaggacgagtcctaggtaacatgactgtggctataataggaactggtcgcattggtctagcgactgctaaaatttttaaagggttcggatgtcgtgttattggttatgatatttaccataatccaatggcagatggtatccttgagtatgtcaattcggtagaagaagctgttgaagaagctgatcttgtgtccttacatatgccaccaactgctgaaaatacgcatctatttaatttagatatgtttaaacagtttaaaaaaggtgctattttaatgaatatggcacgtggagcattggtggaaaccaaagatcttcttgaggctttagatcaagggcttttggagggagctggtattgatacttatgaatttgaggggccatatatacctaaaaattgtcaaggtcaagacatttcagacaaggatttcctaagactgattaaccatccgaaagtaatatacactcctcatgcggcttattatacagatgaagcggtcaaaaatctagtagagggtgccttaaatgcttgtgtagaagtgattgaaacgggaacaactactacgaaagtcaactaaaagatgcttaggcatctttttttgtggggtaacaaaacatatgatgatcatgacctttaaagcaaaaaaacatcttatgtatttatagctggaaagtcttttttataataaaaaaagatattttttataaaaatattgaaaaaacatcagatgaatagtattatttaatcataaaagcgtttacaaaatacaaggagggttctctcatggagaaaacaatggatatggaacaacgtgaagaagttgtatcttataaccgagcgaaagtatggcagttagttatgtttgccatgaacaatgcttctacaaatatatacttatttacgtttatgtttgttacctatttctcaactggcgttcttggctcggcagccatttttgtcagtcaaattatgggttatatccgtatttttgatggttttattgatccagctattggtattatgattgataaaactgatacaaaatttggtaagtatcgtcctattttgattattgggaacgttattacggctttgtcattgatttttcttcttgcattgagaggtgtcgatgaaaatattcgtttcccattatttatccttgttctaattatccataaaattggatactcaatgcaacagacaataactaaagcagggcaaacagcactgacaaatgaccctaagcaacgtcctatttttaatatcgttgatgcagttatgacaacatcattaatgacaggcggtcagtttgtcgtttcagttttcttagtaccaaaatttggtaattttacacctcaattcttcaatgtccttatttttggaacaattcttatttcagctattttagcaatcgttgcaattattgggatttgggcaaaagacagaaaagaattctttggtttaggagagaatacccaaaagactgctctaaaagattactggaaggtgttgaaaggaaataaaccgcttcagatattatccattgctgcagctttggtaaaatttgccatccaattctttggcgattccgttgttatggtgctattgtttggtattttatttggtaattatgctttatcaggacaattctcacttcttttcattgttcctggtgttattattaatattttgttctcaacaattgctcgtaaaaaaggtcttcgtttttcatatgtcagagcaattcagatcggtatgattggtttacttgcttttggtgcagttctttacgttggtaagcctggtgaccttagtttaacaagcctaaatctttatactattttatttatcgttactaatattattgcgagatacgcttcacaagcacctgctagtttagtattgactatgggagcagatatttctgactatgaaacttctgaatccggtcgttatgtatcaggaatgattggaactatcttctccttaacagattcgattgcttcttcatttgctcctatggtagtaggttttgtgttagcaggaattggattttcaaaatcatttccaactatcgaaacaccactgccccctgatttaaaaatggcagctattagtatccttgtggccattccatttatagctttgtctatagctcttcttttaatgaaattttacaaactagataaagaagaaatggttcgtattcaagagaagattcaagttatgaaagcagcaactactaaggaacgtgctaaagatattgctcgtaatgttcctttgacagatatggattatgttgatgtaacaaaatatcctattgataaagattaaaaagtttagctgctcttcaatagagcagctattttgttaaataagagctaccattggaggattcttatggcaaaaattatttcattaggtgaggttcttttgcgattatctccacctcaatatcacacactgatgcaggctaatcacctaaaatgccaattcggtggttcagaacttaatgtcttagcaagccttgctcaactaggttaccatgtaggattggtctcagctttgcctgataatgatttgggcaagatggcaagtcaatttatattgtcacagcaaattagtccagctgctataattaaaaaagaaggacgactaggaatttattactatgaacaaggattttcggtaagaacaaataaggttatctacgatcgtaactattcatctttttgggaaagtaccttgagtgattatgattttacttctatttttaagggagtggattggtttcatgtttctggaattactccagcactaaccaaggacttatatgaggtgactcggttccttatgacaaaagctaaagaaggaggtgtaaaagtatcgattgatctcaattttcgtgagagtttatggtcatcttttcaagaggcacgtgagcaattatcgccactattaggattattagatgtttgctttggcttagagccgatttatttagctggcgaaagtgaagatttaaaagatgagttgggcttatccagaccttaccttgatattgaattacttgaaaagataacccaaaagattgtccaagaatatgggttagactatattgcctttactcaaagggaaatggaatatactaatcagtatatgttaaaatcatatttgtatcataataatatgttatatcaaactgataaaactggcgttgaagtattagatcgtgtggggacaggagatgcctttgctgcaggtttaattcatgcgcttctggaaaaagaaactcctcaaagggccttagaaatagctatggctacatttaaatacaaacataccattcaaggagatatcaatatcatgacacgagatgatattgcttacctcattgaaaaagaaacaaatgatattaaacgatagtgtaaaaggagagtgtatgttatatccattattgacaaaaacaagaaatacttatgatttaggcggtatttggaactttaaattaggagaacataatccaaatgaattactaccttcagatgaagtcatggttatcccgacttcatttaatgatttgatggtaagtaaagaaaaacgtgattatataggtgatttttggtatgaaaaagtcattgaagtacctaaagtatcagaggatgaagagatggtgctgcgttttggctcagtgacacatcaagctaaaatttatgttgacggtgtattggtaggagagcataagggaggttttactccttttgaagttcttgttcctgaatgtaagtataataatgagaaaattaaggtatcaatttgtgctaataacgttttagactataccacgcttccggtcggaaattatagtgaaatcattcaagaagatggtagcattaagaagaaagtacgtgagaattttgatttcttcaattatgcaggtgtgcatcgtcctcttaagttgatgatacgtcctaaaaatcatatttttgatattacaattacaagtcgtctatcagatgatttacagtcagcagatttacattttttagtggagactaatcaaaaggttgacgaagttagaattagcgtttttgatgaagataacaaactagtgggtgaaacgaaggatagcagattatttcttagtgatgtccatctttgggaagttttaaatgcctatctgtacacagcgcgtgttgaaatttttgttgataatcaactccaagatgtctatgaggaaaattttggtcttagagaaatagaagtgacaaatggtcaattcctattgaatcgcaaacctatttattttaaaggatttggtaaacatgaagatacgttcattaatggcagaggtttgaatgaagctgctaacttaatggatttgaatcttttgaaggatatgggggcaaactcttttagaacatcccattatccttattctgaagaaatgatgcgtttagcagatcgaatgggagtgttagtgatagatgaggttccagcagtagggttatttcaaaattttaacgcttccttagatttgtcaccaaaagataatggtacgtggaatttgatgcaaacaaaagcggcgcatgaacaagctatccaagaattagtgaagcgtgataaaaatcatcctagcgtcgtgatgtgggtagtcgctaacgaaccggctagtcatgaagcgggagcacatgattattttgagccattagtaaaactttataaagatttagaccctcaaaaacgtcctgtcaccttggttaatattttaatggcaaccccagatagagaccaagtgatggacctggttgatgttgtctgccttaatcgttactatggttggtacgttgaccacggtgatttaacaaatgcagaagtaggtataagaaaagagttattagaatggcaagataaatttcctgacaaaccaattatcataacggagtatggcgctgatacgttaccgggattacattctacttggaatattccatatacagaagaatttcaatgtgatttttatgaaatgagtcatcgtgtttttgatggtattcctaatttagttggtgagcaagtctggaattttgcagactttgaaactaatctgatgatacttcgtgtacaggggaatcacaaaggtctcttttcaaggaatcgccagccgaaacaagtcgtcaaagaatttaaaaaacgctggatgactattcctcattaccataataaaaaaaatagtgtaaaataggggtagttattttagaagaggtgatgatatggctagacccttagtagaacaaacagcagatcgtctattgcatttaattttagaaagagaataccctgttggtgctaagctccccaatgaatatgaattagcagaagatctagatgttggtcgcagcacaatccgagaagcagtcagaagtttagcaacgcgtaatattttagaagtcagacagggctctggaacatatattagttctaaaaagggtgtttctgaggatccattagggttctctctaataaaggacacagataggttgacatcagatctctttgaactacgccttttattggaacctcgaatagcagagctggtagcttatagaattacagatgatcagttacaattactcgaaaagcttgttggagatattgaagatgctgttcacgcaggcgatccgaaacatttacttttagacgtggaatttcattccatgctagctaaatacagtggtaatattgcaatggatagccttttgccagtcatcaaccagtcaattcatctgataaatgcgaattatacaaatcgtcagatgaagtcggatagtttagaagcacatagagaaattatcaaagcaatccgagaaaaaaatccagtagctgcacatgatgctatgcttatgcatatcatgagtgttagacgttcagcattgaaagcttaatataagaagaaaaatagctattcttgaatagctatttttttagtattcttcttgacaattcatcagatgacttatataatatagttaaagataacggttacattttgggaggtattatgttaaatcaattgaaaaacaactatttctttgctgttattcgagggaaatcatctgaggatgcgctcgaaatcgcaaagcatgctattttgggtggtattcggaatattgaagtaactttttcgactcctgaagcaagcaaagtcatcaaacaattatcagatgactttaaaaataataaagaaattattgtgggggccggaacggtcatgacaactgaacttgctaaagaggctattgatgctggagctaaatttttggttagcccacactttgattcagatattgctaatttagctaatgaaaacaaggtttattatttcccaggctgtgcaacggcaacagaaatcgtggtagctagaaagtataaatgtcagattataaagctttttccaggtggagttgtgggtccaggttttatcaaagatattcatggtcctattccagatgttgatttaatgccatcaggtggcgtctctgtttcaaatgtagttgaatggagaaaagcaggagcagttgcggttggtgttggctcagcattatctagtaaagtagccacagaaggctatgatagtgttactaaaatagctaaacagtttgtttctgcacttgattagtgagtaagagaagaatatggcgtttaatactgaaacatttatgttaaaaaatcaagcagctatacagctgtatgaagaggtcaagagacaacctatttttgattatcattgccacttagatccaaaggacatttttgaagatcatatttttgataatattgtggatttgtggcttggtggtgaccactataaatggcgtcttatgagggctaatggtatttctgaagcagaaattacaggtccagcatccaaccttgagaaatttaaagcatttgctagaacactagaaagagcatacggtaatcctgtttatcattggtctgctatggaattgaaaaatgtctttggtgttaatgagattttgacagaatcaaatgctgaggaaatttatcatcgtttaaatcatttcttgaaagagcataaaataagtcctagacgtttaattgcagatagcaaagttatgtttattggtactacagaccaccctcttgatactctcgagtggcataaaaagttggctgctgatgagagttttaaaacagttgttgctccgacatttaggccagatgaagcttttattgaacatcgacattttgttgattttattactaaactgggtgacattactcaaaaagagattacagatttttcaacatttatagcagcaatggaagaacgcattgcgtattttgctcaaaatggttgtagggctagcgatatcagttttacggaaatcgtctttgaacaaactgatgaattggagttgaacgatttatttaataaagtttgtgaaggctatatcccaaatcaatcagaaatcagcaaatggcaaacagctgtttttatggaactttgccgattatataaaaaatatggttttgtaacacaggtgcattttggagctttgagaaataatcattctactatttttgaaaaattgggagctgacgtgggtgtggattcacttggtgaccaagtggctttaactgttaatatgaaccgtttattggattccttggttaaaaaagatagtctgcctaaaatgatttggtataatctcaatccagcttacaatatagcagtagctaacactttggcaaattttcaagctaacgaacttggagtgagatcttaccttcaatttggtgcaggttggtggtttgcagatactaaattagggatgattagtcaaatgaatgccttagcagagcaaggcatgttggcgaattttattggtatgttaacagattctagaagttttctatcttatcaacgtcatgactattttcgacgtattttatgtacctacttaggagaatggattgaagaaggagaagttccagaagattatcaagctttaggaagtatggctaaagacatcgcttatcaaaatgcagttaattattttaagaactaaaaaggaagagtgaaatcatggaaatgtcatttaggtggtatggtgaagacgaccccgttactttagaaaatattggtcaaattccaacaatgaaagggattgttacagcgatatacgatgtaccagtaggagaagtttggtcacgtgagcgcattcaacagctgaaagaaaaggtagaggcagcagggcttaaaatttcggttatcgaatcagtacctgttcatgaagatatcaaattgggacgtccaacacgtgatctcttgattgataattatattcaaaccgtcaaaaatttggctgcggaaggtattgatactatttgttataattttatgccagtatttgactggacacgcactgatttagcatatcaatatccagatggttccacagctttgatatttgatgagacggtttctaaaaaaatggatccagtaaacggtgaattatctttgccaggatgggatgccagctatagtaaagaagaaatgaaggctatcatggatgcctatgctgaaattgatgaggaaaaactttgggaaaatctcacttattttattaaacgtattattcctgaagcggaagccgtaggcgttaaaatggccattcatccggatgacccaccatattctatttttggtttacctcgcattattactgggttagaggctattgagcgttttgtgaaattgtacgatagtaaaagtaatggcatcactttatgtgtgggttcttacgcttctgatccccagaatgatgttttagagatttcgcgacgtgcttttgagttagatcgtgtaaactttgttcatgctcgcaatattaaattaggtgatggaaagtcatttaaagaatcggctcatccatcagaatacgggtcaatagacatgtatgaagttattaagttatgccatgaatttgggtttgagggtgctattcgacctgaccacgggcgtatgatttggggagaaacaggtcgtccaggatatggcctatacgatagagctttaggagccacttacgtttctggtttatacgaagctgtgattaaaggttcaaaataaggcgatgcttccaaatttctcctgttccaatctcctgaaagagaaatttggaaagttattatcataatatgattgtacttagctaagagtagaatacttatagaagttaatgagaggaataagatgtcaaaaacaattacatttaccaataaagttgtcgtcataacaggtgcaggcggtgttctctgtggttatatggctaaagaatttgcgaaagcaggcgctaaagtggcattattagatttgaatcaagaagctgctcaaacatttgctgatgaaattgtagaagaaggtggtatcgctaaggcttataaagctaacgttttgtctaaagaaaaccttgaagaagtgcatcaagccgttttagaggatcttggaccaactgatattttagttaatggtgcaggaggcaacaatcctaaagctacaactgataatgaatttcacgaattagacttaccttcagaaacaaaaaccttctttgagttagatgaagctggtattagctttgtttttaacttaaattatttaggaacattattgccaacgcaagtatttgcccaagatatggttggacgtgaaggagcgaatattattaatatctcttcaatgaatgcttttacccctctgaccaaaataccagcttattctggagctaaagcagctattagtaacttcacacaatggctagctgttcatttctcaaaagttggtatccgttgtaatgctattgcacctggtttcttggtaacaaatcagaaccgaagcttgttatttactgaggacggtcagccaactgcgcgtgctgagaaaattcttaataatacaccaatgggaagatttggagaagcaagtgagctgattggcggattgttctttttagcagatgaaaaatcatcaagttttgttaatggcgttgtccttccgattgatggtggatttgctgcttactctggtgtttaatttacaagataatagccacttaacacataagagattattgagttgagtggttttttaaggaaatttgtttaatgatcttaccactaaatgatgggtaggttgctaattggaaaatcctcataagttagataaatttagaaactggagataatatggtagatacaaatcacaaaatcgctttttgcatagattctgatggttgcgcaatggatacaatgacatataagcatcaactcttttttggtccaattgctgcagatatatttgggatatcagaacaagaaagaacaagttttttaaaagagtgggatagagtcaatctttattcaagaactcgtggagttaatcggtttgtgggattggttatgggccttgagtttgccggagtagaacatattgataaattaaaagaatgggtcgaaacaacagactcattgtccaataattccttagagttagcgcttgccaacgattttagtagagatttagagaaggctttagaatggtccaatgaagtgaatcgccaaatcaaaaattatgagggagattctttagcgttttcaggtgtgttagaaagtttagaacgattaagtcaatttggtaatgtttatgtcgtgagttctgctaacaaggaagctgtttggcaagagtgggaagaacagggattgctaaagtatgttgatgatatctattgtcaagatagaggtaaaaaagaagatgttatcgccactttaattgcaagtggttactgccgtgaaactattttgatggtaggagattccctgggtgatctggctgcagcagaacaaaatggtattgcattttacccagtacttgttggtaaggaagtcaaatcatgggaaattcttagagaagatattggtgaagcttttgcaaaaggtcaattcgaacagcaaaggcaaaaagaatctattaataccttttgggctaatttagataactaatagaaaggataggctatgacacatttagttgacttaacaaagaaacccttcaatctaaatcaagaagcaattgagtggattgaaaaaacaattaatgagatgacattggatgagaaaattgggcaactttttttcaatatgggagctagtcgttcagaagaatatttaacagatgttttggatcggtatcatattgctgctgttcgctataatagaggtagttcaagtgaaatctatgatcagaatttaattttacagacaaagtcgaaattgccgatgttgattgctgcaaatacagaagctggtggagacggtgctgtcacggatggaactaaagttggcgatgaaataaaagtggctgctacaaatgatccgaaatatgcttatgaaatgggaagaatcgcagggatggaggcatctgctgtgggttgtaatgcttcattttctccaattgtagatttgacacgtaattggcgtaatcctatcatagctagtcgaaattggggtgctaacgttgatcaaattatttcactttcaaaagagtatatgaaaggaatcatgcaatataatattgtacctttcgctaaacattttccaggggatggcattgatgagcgtgatcatcatttgtcatttgcttccaatcctatgagtaaagaggagtggatgtcgacatttggccgcatttatggtgaattggctgacgcaggtttaccaggagtcatggcaggtcacatacatttaccaaacgttgaaaaagaaatgcatccagagcgagaccttgatgatatgttaccagcttcattgaataaaacacttttagatgagttattgagaggagagttaggttataatggagctattgtaacggacgcttctcatatggttggaatgactgcttcaatggcaaggagagatttgttgccaacggcgattgaagcaggttgtgatttattcttattctttaatgaccctgatgaagacattcaatggatgaaagaaggttacgaaaaaggtattctaacagaggaacgtctccatgacgctttacgtcgtactctcggtctaaaagcgaaattaggcttgcataactatgagggacgtcgccaagaactctttatgcctaaagataaggctatggctttaatcaacacattagagtcgcaaaaaatagctgatgaagttgctgataaagcagtaactctggtaaaagataaacaaaaagatatctttccagtaaatccagaacgttatcgtcatatcttacttgttaacgttgaaggatataagggaggttttggtgcgatgattgctggaaacaagcaacgtgcatcggattacatgaaagagttacttgaggcacgtggccatgaagtaactgtctgggagtctaccgaagagcgtattatgaaattgccacaagaggagcgggcagcagctatcgctaatgtttacgcacaaaaacagccaatcgcaaatctaacagaacactatgacttgattattaacttggtagatgtcaatgctggaggaacaacacaacgtattatttggccagcagctaaaggcacccctgatcagcctttttacgttcatgaaataccatctattgtgatttcagtacaacatgcatttgctttagcagatatgccacaggtagggacttatattaatgcttatgatgggcttcctagcacgataagtgcagtagttgcgaaattggctggagaatcagaatttacaggagtttcaccagtagatgcttactgtggtttaattgatacacatttatggcgccaatgctaatagaaacaagatgatgtacttttatgtaacataaaaaaagagcttaaagctctttttttatccttcaaaatagagtagttccttgggtgttttggtaaatacttcaaagccggttttagtcacataaccgcagtcttcaattcgcacaccaactttatctggtatataaatacctggttcaacagagaagcacatgccttcttgaatctccatatcgttaccagccataatagatggaaattcatggacatccatacctaatccatgaccaaggcggtggttaaagtattgtccataaccagccttttcaataacatttcttgctgctgcgtcaacttcagaagcaaggactcctggcttaataaaatcaatagccgcttgatgtgcttcaagacataaatggtaaatatcttttttgaattgatcaggtttccccactgctactgtacgggtcatatctgacgtataacctagtgtttctacacctaaatcaaataataacaaagcattattttcgattttattagttcctgggataccatgtggatttgctgcattattgccagtcaaaaccatagtgtcgaaactcattttattgataccttgttttttcatttcaaattcgatttgagcgataatatcggtttcagtgttgtttagcgagatattgtcaaatccaacttgaacagctttatcagcaaattctccagcgactaacattttctcaatttcatctcgtgatttaattaggcgcatgttttgaatataaggtgttaggttttcaaaatgaccatcaaaaacggtttggagaccttggaatttagtaacattaagattatcaaattcggctagaactttagaaacagaaaaggatggtaagttgctagctattttttgccaaggattttctgaatctatgtaaccaaagacgggaaatggtacactttgttttgcacgcgatacttctagtgctggtacaaataaaataggatcgcgatcttcatagacaaataaaaacatttgtctttcatggggatcgcaaaagaaacctgttaaatagttgactgtcacaggatcagaaaagacagcaagttcagcttggactgaatgtaagtgatggcgtatacgattaagttttgacataataacccttcttcctaaaaggaacttagtctagttaggctagtttcttatgcctattatttttccaaaaaaataggaaaaaatcaagtttagttagtattttgaaagtttttcataaaaaagctttataaaagcttgaaagtgtttccaaaaggtgataaaatatcagtgaaagcgtcattttcaaatagaaaggaagttaaatcaatatgaatacagatgatacgattacgatttatgatgttgcccgtgaagcaggtgtttcgatggcaactgttagtcgtgtggtaaatggaaataaaaatgtcaaggaaaatacacgtaagaaagtccttgaagttattgatcgtcttgactatcgtccaaatgctgtggcgcgtggtttagcaagtaaaaaaacgacaactgttggtgttgtcattcctaatatcgcaaatagctacttttcaattttagcgcgtggtattgatgatattgcagcaatgtacaaatataacattgtccttgcttcaagtgatgaagacgatgataaagaggttaatgttgttaatactttgtttgctaagcaagtagacggtattatttttatgggacaccacttaactgaaaagattcgtgcagagttctctcgttcacgcacaccgattgttttagcaggtactgtggaccttgagcatcaattaccaagtgttaatatcgattacaaagcagcagcagttgatgttattgatattttagctggcaatcataaagacattgcttttgtatcaggaccacttattgacgatattaatggcaaggttcgtttggcaggatacaaagaaggtctcaagaaaaatggcttaaactttaaagaggggttggtttttgaagccaactaccgttatgctgaaggctttgcattagctcaacgcgtgattaatgctggagcaacagcagcatatgttgctgaggatgagttagcggcaggtttgttaaatggtctttttgaggcaggtaaacgtgttcctgaagattttgaaattatcacaagcaatgactcgccaatcgcacaatatacacgtcctaacttaacttctatcagtcaaccggtctatgatttgggtgctgttagcatgcgtatgctaacaaaaattatgcacaaagaagagttggaagaaaaagaaatagtgcttaatcacgggattgttaaacgtggcacaacaaataattagtgttagagtatgttatttgaaaaatagtggtagaatggtagtagcttagcgcttaactttctgatacttaacatgatatattgagaggattagggtagcttagcttcctaatctttttttagaggtgtaatatgacaaatgaattgataatgcaagcttttgagtggtatttacctagtgatgggaatcactggaagaaattagaggagtctatatcagaccttaaaaaacttggaattagtaaaatctggttaccaccagcatttaagggaactagcagtgatgatgtaggatatggtgtttatgatctctttgatttaggagaatttgaccagaatggaacaattagaacaaaatatggtaggaaagaagagtatctaaagcttattaagtcgttaaaggcaaatggcattaaaccgtttgcagatatcgttcttaaccataaagccaatggtgatcataaagaaaaatttcaagtcatcaaagtcaatcctgaaaatcgtcaagaagcattaagtgaaccctatgagattgaaggatggacgggatttgatttcccaggtagacagggtgagtacaatgattttaaatggcactggtaccactttactggtttagattacgatgctaaaaataatgaaacagacatctttatgattgtaggcgataataaaggttgggcagacgatgatttgattgatgatgaaaatggtaatttcgattatctcatgtacaatgacattgattttaagcatcctgaagttataaaaaacttacaagattgggctaagtggtttattgaaactacaggcattgaaggttttcgtttggatgctgtgaaacatatcgattcttactttattcaaactttcattaatgatattcgtacaaaaataaaacccgatttagaggtctttggcgaatattggaaatctgaccaaacatcaatgaaggactatttagaggcaacacaatttcaattttctcttgttgatgttaccttacatatgaatttttttgatgccagtcaccaaaaccgtgattttgatatgcgaacaatttttgatgatagtcttgttattgataatcctgagtatgctgttacattcgtagaaaatcatgatacgcaaagtggacaagctctagaaagtagagtggaagattggtttaaacctttagcttatggcttgatacttttacgccaacaagggactccatgtcttttttatggtgattactatggcattcaaggagaatttggtcaaccatcctttaaagaggttattgataaaatggctgagctacgccaaaactatgtatttggcaaacaagtcgattattttacgcattcaaattgtattggttggacttgtcttggggatgaggaacataattcttgtttagctgtggtcctaacaaatggtgatcagggatggaaacatatggaagtaggggaaatttatgcaggcaaaacgtttgttgattatttaggtaattgtgaacaagaggttgttataggagatgatggttggggtgattttttagttgaatctgcgtctatctcggcttgggttcctaaaatagaggaagctaactgataaatcaggtgaaaaaaaaggtaaaatgagatataataagacctatgaaagttttactgtatttagaggctgaagaatacttgaaaaagtcaggtatcggtcgtgctatcaaacatcaagagaaagctcttcaaattgctgggatagattataccactaatcctacagatgactttgaccttgttcatatgaatacctatggtattagaagttggcttttgatgagtaaagctaaaaaaactgggaaaaaagtaattatgcatggccattccactgaagaggactttagaaattcttttattggctcaaatttagtatccccgctttttaaatggtacctttgccgtttttatcaaaaagcagatgccattataaccccaactgattattctaaacaactaataaaagcatatggcatcaagaaaccaatttttgttttatctaacgggattgatctaagtcgctatcagaggtcagaaaagaaagaatctgcatttcgtcactattttcacttaagtaaggatgataaagttgttatgggggccggtctttatttcatgcgtaagggaattgaccaatttgttgaagtagctgcaaaaatgcctgatattcgttttatttggtttggagaaacaaataaatgggttattcctcgaaaggttaggcaaatcgttaccaagcaacatccctcaaatgttacttttgctggttacataaaaggtgatgtttatgaaggtgccatgagtgctagcgatgctttcttctttccgagtcgtgaagagacagaagggatagtagttttagaggctttagctagtcatcagcatgtggttttaagagatatccctgtgtatcacggttgggtgaccgaagacagtgttgaattagcgactgatgttgatggttttgttgaaaagttggataaagtcttatctggtaagagtgataagattaaagaaggttatcatgtggctgagagtcgaagtatcgaacgaattgcccatgaattggcaagtgtttatcaaaaagtaatggagttgtaagatgcgtataggtctatttacagatacatacttcccccaagtttcgggagtttcaacaagtatccgcactttaaaggaagggttggagaaggaaggacacgaagtttatattttcacaactaccgaccgtaatgtcaaacgttttgaagaccctacaattattcgtttaccaagtgtcccttttatttcttttacggatcgtcgagtagtttatagaggtttaatttctgcttataggatagctaaagactacgaacttgatattattcatactcaaacagaattcagcttagggcttttaggaaaattagttgcaaaagctttaagaatacctgttgtgcatacttatcatactcaatatgaggattacgttggttatatcgcaaaaggcaaattgattaagccaagtatggtcaaatatatcatgcgtacctacctaagtgatttggatggtgtcatatgtccttctcgaattgttctcaatcttctagatggttacggtgtcaaaattccaaaacaagttattccgacaggtattcctgttgagaactatcgtcgagaggatatctctgaagaaacaatcaagaatctacgaacggagcttggacttgcggataatgatacaatgctattgagtttatcacgggtatcttttgaaaaaaatattcaagcaatcttgatgcatttatcagctgtcgttgatgaaaatcctcacgtaaaattagtgatagttggagatggtccttatctttcagatctaaaagaacttgttcactctttagaacttgaaaattcagttatttttacaggtatggttgagcatagccaagtggctatctactataaagcatgtgatttctttattagtgcttcaacaagtgaaacgcaaggattaacttacattgagagtctggcgagtggacgtccaatcattgcgcaaagtaatccttatctagatgatgttatttcagataaaatgtttggaactctgtacaagaaggaaagtgatttggcagatgctatcctagatgcaatagcagagacacccaaaatgactcaagaagcttatgaacagaaattatatgagatttctgctgagaatttcagcaagtctgtatatgctttttacctagactttctgatttcacaaaaagctagtgtgaaagaaaaagtctctctgacaataggaaataaggatagccattctactcttcgttttgtcagaaaagcggtatatttacctaagaaagtttttacctttacaggaagagcctctaaaaaagtggtaaaagcacctaaacgtcgtatttcatctattcgagattttttagattgagacgaataaaattagtaaatgtcttgaaattataaaaaatattgttataataaaaaatgaagacatgttaggttctaatagattttaagagcgagcactggttggtggaaagagtgcaattagagaacttagtactacttccttgattttatgcaaacataaaagggtggttcccttatcgccactagaggtctgacacaagtatactcgagtttttgtgttggataaattgaggtggaaccacgtagtctttacgtccttttggatgtaaaggctctttttttataaaagaagtggttgcataaaagaggcagattgctttgctaatgttatacttattatccctagctaggataatgtggaattcaatcaaaggtcaatccctttgtttattagtgaattaatgtgtttaggaattggtatcatcctaacagttattaagaaaaggagaacaagatgattaaaatcactttcccagatggtgcaattcgtgaatttgaatctggcatcacaacatttgaaattgcacaatcaatttctaactctttagctaaaaaagctttagctggtaaatttaatggtcaacttattgatacaacacgtgctatcgaagaagatggtagtattgagattgtaacacctgaccacgaagatgctttaggagttcttcgtcactcagcagcgcatttatttgctcaagctgcaaaacgcctttttccagacttatgtttaggtgtaggtccagctattcaagatggtttttactacgatactgataataaatcaggtcaaatttcaaatgatgatcttcctcgtattgaagaagaaatgaaaaaaattgttaaggaaaatcacccttgtattcgtgaagaaatcagtaaagaagaagcgttagaactttttaaagatgacccttataaagttgaattaattagtgaacatgctgaagatggtttaactgtttatcgtcaaggtgaatttgtagacctttgtcgtggacctcatgtcccatcaacaggacgtattcaagtctttcatcttctaaatgtcgctggtgcttactggcgtggtaacagtgataatgctatgatgcagcgtgtctatggtactgcttggtttgataaaaaagatttgaaagcatatcttaaacgccgtgaagaagctaaggaacgtgaccatcgcaaattaggtaaagaacttgatttatttatggttaatcctgaagtaggtcaaggattgccattctggttgccaaatggagcaactattcgccgcgaattggaacgttacattgttgataaggagattgcttcaggttatcaacacgtttacacacctccgatggcatctgttgaattttacaagacttctgggcactgggaccactatcgtgaagatatgttcccaacaatggatatgggagatggagaggaattcgttcttcgtccaatgaactgcccacaccatattgaagtttataaacatcatgttcattcatatcgtgaattgccaattcgtatcgctgaacttggtatgatgcaccgttatgaaaaatcaggggccctcacaggattgcaacgtgtacgcgaaatgacactcaacgatgcccatattttcgttacacctgagcaaattaaagatgaatttcttaaagctcttaatcttatagcagaaatttatgaagattttaacttaacagattaccgtttccgcttatcttatcgtgacccagaagataaacataagtattatgataacgatgagatgtgggaaaatgcacaagctatgctaaaagaggctatggatgattttggattagattattttgaagcagaaggcgaagcagccttttacggtcctaaattggatatccaggtgaaaactgctcttggtaatgaagaaacactatctactatccaactagatttccttcttccagaacgctttgatctcaaatacatcggtgcagatggtgaagaacatcgtccaattatgattcaccgcggtggtatttcaacaatggagcgctttacagctattttaattgaaacttacaaaggtgcctttccaacttggcttgctccacaacaagtttctgttattccaatttcaaatgaagcccacattgattatgcttgggaagtggctcgtgtccttaaagatcgtggtattcgtgctgaagtagatgaccgtaacgaaaagatgcaatataagattcgtgcggctcaaacccaaaaaattccatatcaattgattgttggtgataaggaaatggaagaaaaagccgtaaatgtgcgccgctatggaagcaaagcgactgaaacaaaatctatagaggaatttgtagaaagtattttagctgatattgcaagaaaatctagacctgacgaagttaaataaattttattagtcattataaaaatcattaataaatgatgtgaactgattactgtatgatgcagaatcagttttttagatgctaattttttctttatgtttaattataagctaattatagataaataatctcatataacattcacaaaattagatttttttggtataattaatatgattgacacataaaggaaaatagtattaataaaaaggggtatggagcattgcgaacagtattagtagtgcaaggtgatgacgaaacaatagagttattaaggtcgtatttagagggagctctttataaggttgtgatggctagtgatggtgaggaggctttttctttatttcagcaacatcagattgatttagcaatcatagatattacgctacctaaaatagatggatatgagttgacgcgactcattcgtcaagatagtcagattcctattattatgctagcagctaagacaacagatatggacagaatattaggattgaatattggagcagatgattttatcacgaaaccgtttaattctttggaggttttagctcgaattaattcgcaactgcgtcgttactatgaattcaatagtcttgccaaacctaaaaatcaatttataaagataggggaattggaattagatgaggaacatgttgaactaactaaaaatggtaaacatatcaagttgactgctacagaatttaagattcttcatatcttaatgtcatcaccaggaaggatttatactaaaacacaactctatgagaagattaatggtaggtatttagaaggtgatgagacaacgattatggtgcatatttctaatatccgtgacaaaatcgaagatgatagtaaatatcctaaatatataaaaacacttagaggagtaggatataaaatcgaaaaaccgcagtatcttgtttaaaaatataatggctagtaagagccattttttagtgaagatatttcttggttttaagctttcctttttgctataataagtaaaattggaggggagagatatggcaaagaccgctcttaatattccttttacagttgaagggatagaaaattattatcaaaatataaaaatgatactgtctttagcagataaatggagcatacctaaagatgatctattactttttttaaagggcctcaaggctattgatgatataaaagttggctctcctatttttaagtatttttggacttctttaagtttacaagcacccctcaaagctttagaattcgtgttagagcaggctaaaatgccaactgaattgtcaggagaattatcagaaacacaatacttggtcgcacagttttcagatgagttagctccacatgatgatttctggatagccttatcacaagttatttatgattcttttcctgggaatagtctagccgaagatactgtattaaataggaaactccatcaattccgctatttgatttctagtcagcaagcacagtatgttcgacgatactttaaagatgttggtatgactgatagagatgctttagtaaactacctatcatgtttaagagaaccagatagtatcgcctactatgaatctgctcgcttgcataataaacgtcggagaaatggtgaaatctttggtttcccagatgatgagccggttattaatagtaagcttttaatttcattccatacggaatttattattgatgacaaaggaaactttttaaacgagattgacgcagaagtaataacacgtaatggtattatcaatggagctagctttaattatgcttttaaaaataatacacgtcataaagaattagatgttgatcctgtaaagttagacccaaaatttcgaaacgatatgactagaggttatagatcgccaaatctatctagaaggaaatggtttttctttaaagaagaggattacgattgtagttatttcaataaaaaaggatattacgcatttggaaggcgtagtgctaagcaatcggttgataaacaagtcaaatacttgaagaaggctgtgcagaaaatgcgcatcaactgatacatatactattaaaagataccatagtactatggtatcttttaatttgaggtattaatgtcaaatggttttttattgaccacatgtttttataaacgagtggtcaaaattgaagaagtatctagcttatgttaaaatataattgaataatagaaagaaggtgctgtatgattaagaaaaataaagtttttttaggagttcttttagtccttgttgttatccttggaggtggtgtattattttaccaatcacaattccaaaagacaactaatcaagcgttagctattgcttataaagatgctaaagtggctaagaaggatgtcatacatcaaaaaattgacaaagaatttgaaaactttagagggagctacgaaattgaattcaataccaaaagcgcagaatacagctatcatgtagatgttaagactggacaaatccttgagcgggacatggataataatggcttttcaaaatcgacttctcagtcaagttcatcgtcaagtcaaaaatctcataaaataagtcaagaagaagccaaaaagattgcatttaaagatgctaatatagaggaatcagaagtcagtaatcttaagatcaaagaagaaattgaaaatggaaaatcagtttatgatattgactttgtggacctgaaaaataaaaatgaagttgattatcaaattgatgcagaaactggaaaaatcattgaacgttctagagatcatatgaatgattaatttaaataagatataaaaaaacgaaggtctaaaaggccttcgttttaattactcagtagcttgctcccaacgttttgaaagtttacgtgaaaaacttgagatgataaagtttgtaatgaaatagacagcagttataatagcgtagagtgtaaaaacttgtccagcttcgaaatatcttcccattagaatttgactttttccgaagatttcttgaatagctataacagaataaagtagtgatgtatcttttataaccgttacaaactgagaaataatggctggcaacattttgcgaaaagcttgtgggaaaataataataatgaaaacttgcaaataagtgaatccttgagaaagtccagcttctgtttgtcctttatcgactccatttaaacctccccgaataatttctgctaaagcagcggaggtaaaaattgtaaacgaagtaataccagcgctgactgatttcatctggaatactaagaaaatgataaaaatccaaagtagatttggaacatttctgacaaattcgatatagatactagctattaatttccagataggatttttgctatttctcataattgctaatagagttccaaaaaacattgatagtaaaatggaaataaaagatatatataaggttaaaccgaacccttgaaggagaaatagtatctttgttagtgttaagactgatgacatatcaaacctccttaagaataagttttcttatttaattcttcttgttttcttgcccagcttgctagtgggaaacaaataacaaaatagaagatagcagctcctgcaaaagctgggatataattagtcgtatcataagcccaggccttagctacaaacatgatatcggctccagaaatgattgctacggtagaggtattcttgattagattaacaacttggttggtcattggtggtaaaattgttctgacagcttgaggcaaaatgataagttgcatggtttgattagctgtgaatccttgagctaaagcagcctctgtttgtcctttagggacagcttcaattcctgagcgaataacttcagaaatataggcaccatggtatagtccaacgcacaaaacggcggtgaaaaaagcactaatcataacatgtccattactaatgattgctagtccatagtagacaaaaaccatttgaactaaaagaggtgtgttttgaaaaacttcaacatagatacgtgatatcaacttaccaactttacttttagaagttgataaaccaccagagagaattcctaatatcagagcaagtaggagtgcaccaaacgaaatacctagagtatataagaagcctttaaagaataggtcgaaatggttaaagaaagcgccccaccttgaaatggcaaaaggactgatgtttaataaagtcataaaaaatcctccctattctttttttactttagcgggtttaagcttaaatttttgataaatgtgttttaaactaccatctttttcccatgataccagtaacttattaacgtagggaatcaagactttgtcctgtttactggttgcaataccgtattcttgcgtattgaacccttcttttaatatggttgtatgagggctaaggtagccgctaaggatagatttatcaactgaaaaagcatcaatacgattagcgtacagcgatatcgctaattctgggaaactccctaattgagcatagctaaattttagcttgtgttctttagcatatttttctaaattgacttttgtagtggcaccttgagccacaccaatgtgtttaccatccaattcttttatagttttgatatgactatttttacgcaccaaaaatccaatttcatcgtgataataagctttagaaatattatagttagcttttctttcgggcgtgatagtgtatgttgcgattagaatatcaatttgcccattgtccatcagaggctctctggtttgtgcggttgtcggtacaaaaactggtttgacacctaaggatttggcaatttttttggcaatatcaatttccattccttcgtattgattcgtctcagcattataataaccaaagttaggcacatcttgtttgactccaactttaaggacgcccgattttttgatttctgataattgattagctgacgttgagttaggataaaataacaggaaaataaaaatacaggataatagatagaacgttaatctttttcgtctcagcatatttcgtcctcctaaaggtcagtactggtatggttgataatgttgcttaaaaattgtttagcacgtggttctctgggattatcaaaaaagtcttgtacatctgtagtatccactaaaatttccccatcagccataaaaataatacgatcagcaacttctcgtgcaaatcccatttcatgagttacaacgaccatattcattccgtcatttgccaatttttgcatcactgaaagaacgtctccgatggtttcgggatcaagggcagaggtaggctcatcaaagaggaggagttttggatgcatggcaagccctctagcaatagcaattctttgtttttgaccacctgatagcatagatgggtaggaatcttttctttcccacatattgacaaattttaaatatttttcagcaatttccatagcttcttttttagattgttttaatactttaataggagctaatgtaatattttctaacacggttttgtgaggataaaggttaaaatgttgaaaaaccataccaacttctttacggaggttgaccaattctttagatgaaatatttgctaattcatgtccattcacgaccaaactaccatcgtcaatagattcgagagcgttcattgttctaataagtgttgatttacctgatccagaaggtcctaatagaacaaccacttgccctggctctatttccaaattaatctgacgaagggcgtgataatctccataatacttgttaacattcttataagatatgagtgacataagaacctcctaaaataacagtttattgttaggttacctaacattatagataagtgtatcacctgtttgtgagcttgtcaataaattcagaatattaaagagtaggattgatttaaatattgctatttttagagcggtatttttagtaaaaatattacgttctcgtatcatttatttttcagtttaataggatgtattgaaagtttccaattaactaggaaatctgttataattagtgataatagtggtgctttaggcccatattatcatattttcggtcacttttatttttcagtttatgaatggaagtgggagaccagaaagtaatagaggtaaaatatgaaaaaaatacttatcgttgatgatgaaaaaccaatttcagatattatcaaatttaatttaaccaaagaaggatatgagacggcgacagctttcgatggccgtgaagctttagtacaatatgcagaatttcaaccagatttaatcattttggatttaatgcttcctgaactagatggtttagaagtggctaaggaagttcgtaaaaccagccatattcctattattatgctttctgcaaaagacagtgagtttgacaaagtcattggtttagaaatcggtgcagatgattatgttactaaacctttttcaaatcgtgaacttttggcacgggtcaaagcacatttacgacgtactgaaaatattgaaacagctgtagcagaagaaagtgctcaaaatgcttcttcagatattactattggtgagttgcaaattttaccagatgcctttattgctaagaaacgtggcgaagaaattgaattaacgcaccgagaatttgaattacttcaccatttagcgacacatatcggacaagtcatgacacgcgaacatttattggaaacagtttggggatatgattattttggagatgtccgtacagttgatgtgacggtgagacgtttacgtgaaaagattgaagatactcctggtcgtccagaatatattttgactcgacgtggtgtaggttattacatgaagtcttatgaataatagtgctgcaaatattaggtcgtttgagctagccttactttttttactagtttttgttgctgtttattttgtttatctagcggttagagattttaaaatgtctaaaaatatccggcttttgaattggaaagtcagagatttgatagcaggaaattattcagatagtattctaattcaaggtgatgcagatttggtagaattaggtgaaagtctaaatgatttatctgatgtcttccgaatggcacatgataacttagaacaagaaaagaatcgcttagcaagtatcttaacttatatgactgacggtgtgctggctacagatcgttcaggaaaaatcgttatgattaatgagacagcccaacagcagttcaatctagcatatgatgaagctttatcaatgaatattgttgatatgttagggtcgggaagtccatattcgttccaagatttagtctctaaaacgccagaggtagttcttaatagacgtgatgaaaacggtgaatttgttaccttacggattcgatttgctttgaaccgtcgtgaaagtggttttatttccggtttagttgcagtgtcacacgatgctactgagcaagagaaagaagagcgtgaaagaagactttttgtatctaatgtttctcatgaacttcgtacacctttgacatctgtaaaatcttatttagaagctttagatgagggagcgcttaatgaagaagttgctccaagcttcattaaggtatctctagatgaaacaaatcgtatgatgcgtatgatatcagatttattaagtttatcgcgcattgataatgaagtaacgcatttagatgttgaaatgacgaattttacagctttcatgacctcaattttgaatcgatttgatcagattagaaatcaaaaaacagtcacaggaaaagtttatgaaattgtcagagattatcctcttaagtcaatttgggtggaaattgatacagataagatgactcaagtgattgataacattttaaataatgcagtcaagtattcaccagatggtggtaagatcacagttaatctacgcacaactaaaacgcagatgattttatcaatatcagaccaaggcttaggtattcccaaaaaagatttacctctcatctttgatcgtttttatcgtgttgataaggcgagaagtcgtaaacagggtgggactggacttggtttgtcaattgcaaaagaaattgttaagcagcataagggatttatttgggctaagagtgagtatggtaaagggtctacttttacaatagtcttgccttatgataaagatgctgtaacttatgaagaatgggaggacgttgaagattaaaacatgtcagaaataggatttaaatatagtatcttagcttcaggttcaactggaaattgtttttatattgagacaccccaaaaacgtcttttaattgacgctggtttaacaggcaagaaagtgactagccttcttgcagaaattaatcgtaaaccagaagatttagatgctatactagttacccatgaacattctgaccacattaaaggtgttggcgtattggctaggaaatatcaccttgatatttatgccaatgagcagacgtggaaagttatggatgagcgtaacatgttaggcaaagttgatgttagtcaaaagcatgtttttggacgcggtaaaaccttaactttcggggatttagatattgagagctttggtgtaagtcatgatgctgtggatccccaattttaccgtatgatgaaagatgataagagctttgtgatgttgacagatacaggatatgttagcgaccgaatggcaggcttgattgagaatgcagatggttatttgatcgagtcaaatcacgacattgagattctacgttcgggttcttatccttggacacttaagcaacgtattttatcagataaaggacatttatctaatgaagatggttcagaaaccatgattcgcactataggtaaccgtactaaacacatctatttaggacacttgagtaaggaaaataatattaaggaacttgctcacatgactatggaaaacaatttaatgagagctgactttggtgtgggcacagatttttctgttcacgatacttcacctgattcagctaccccactgacgaggatttaagattgaaaaagattttttacattagtttaggatttattagtttagggataggcattgcaggtattgtcttgccggtagttccaacgactccattagtattgctttcagctttttgcttttcgagaagctctgaaaaatttgatatttggttgcgtcaaactaaagtttataaatactacgctgcagattttgttgaaagcagaagtattgccccagcgcgtaaaaagtcaatgatttggcaaatttatatcttgatgggaatttcaatctattttgctcctctaatgtggctcaaactgggattattgattggaactattgtaggaacttatgtgcttttttatgtagtacctgataaaattgatgaatagttaacaagagactaggtgtgtatcctagtcttttgttgaatattcaaatatgtaattaaggaaacgttttctttggaagataggtttaacttccaaaatgtttgattatttgtcaactgtggtataatggtatttgtttaatattttatctatgattgaaatcaaggagaaaaaaatgaaagaattaagatcaaagctggaaaaagactatggtattgtttttgctaatcaagaattattagatacagcttttacccatacatcatacgcaaatgagcatcgcctcctaaacatttcacataatgaacgtttggaatttttaggagacgctgttctacaattacttatttcacagtatctttttacaaagtaccctcaaaaggcagaaggtgatttatcaaaattacgttcaatgattgttcgtgaggaaagtcttgcaggtttttcacgtctatgtggctttgatcactatattaaacttggaaaaggagaagaaaaatctggtggacgtaatcgtgacactattttaggagatttatttgaggcttttttaggagctttattattagacaaaggtgttgaagtggttcatgcctttgttaacaaggtaatgatccctcacgttgaaaaagggacctatgagcgtgttaaagattacaagacaagcttgcaagaattacttcaatctcatggggatgtaaaaatagattatcaagttactaatgaaagtggtccagcacatgcaaaggaatttgaggtgactgtatctgtcaaccaagaaaatttgagccaaggaattggacgatcaaagaaagctgctgaacaagacgctgccaaaaatgctttagcaacgttacaatgaggaaatcatgtttttaaaagaaattgaaatgcaaggctttaagtcctttgcggataaaactaaggtagaatttgatcaaggagttactgctgttgtaggtccaaatggatcaggtaaaagtaatatcacagagagtttacgttgggcattgggagaatcaagcgcaaaaagtttacgaggaggtaagatgccagacgttatatttgctggtacagaaaatcgtaagccccttaattatgcgcaagtgagtgttactttagataatagcgaccattttatcgaaaatatagctgacgaagttcgagttgaacgtcgtatttttcgaaacggagatagtgaatatttaatagatggacgcaaagttcgcttacgtgatattcatgatttatttatggatactggattaggaagagattctttttctattatttcccaaggacgcgttgaagctatttttaatagtaaaccagaagagcgccgtgccatatttgaagaagccgctggtgttctgaaatacaaaacacgtaagaaagaaacacaatccaaattagaacaaactcaagggaacttagatcgcttagaggatattatttatgaattggacatgcaagtccaaccattagaaaaacaagcaagtattgccaagcgttttttagtattagatgaggaacgacaaggactccacttatctattttgattgaagatattttacaacatcaatcagatttaactactgttgaggaaaagctattgacagtaagaaaagagttagcaacttattaccaacaacgtcagtcccttgaagatgaaaatcaatcgttaaaacagaaacgtcaccatttatctgaagaaattgaggctaaacagttagctcttttagacgttacaaagttaaagtcagatttggaacgccaaattgatctgattcgtttagagtcaaaccaaaaggctgaaaaaaaagaagaggcaggtcaacgcttagcagagttagaaattaaagctaaagattgtagtgaccagattacccaaaaaaatatagagttaactactctgtcggaaaaaatagcccaaataagatcagaaattgttagtacagaaagttccttggagcgtttttcaactaatccggatcagattattgaaaaacttcgagaagactttgttaccttgatgcaagaagaagccgacacttcaaacgctttaacagctttactagctgatatagagaatcaaaaacaagcttctcaagctaaatctcaagaaatacaagaagttagcaaaaatttagaagtattaaaaagtaacgcaaaggtagcattggaacgatttgaggctgcaaagaagaatgttcgtcagttattatctcactaccaagatttaggtcaaaccttgcaaaatctagaaggtgagtataagaatcagcagtcaattttatttgatcatttagatgaaatcaaatcaaagcaagcacgtatttcgagtttagaatctattttgaaaaatcatagtaatttctatgctggagtgaagtcagttctacaggctaaggaccagcttggaggtatcataggtgctgttagtgagcatcttagctttgacaaacattaccaaacagcattggagatagctttgggaggtagcagccaacacatcattgttgaagacgagagtgctgccaaacgttcaattgcttttttaaagaaaaaccgccaaggtagagcgacatttctgcctttaactacaataaaaccaagagaattagcacaacattatctctcaaaattacaaagttctcaagggtttttaggaatagctagtgaattggtaacctatgatcaacgcttgtcaaacatttttaaaaataacttagggttaactgctatttttgatacggttgataatgctaatgtagctgcgagacaattgaattatcaagtacgtttagtaaccttagatggaacagagttacgccctggagggtcgtactcagggggagcaaatcgtcaaaataatactgtttttatcaagcctgaattggataatctaaaaaaagaattgaaacaggcacaaagtaaacaattaattcaagaaaaagaagttgccacattgttagagcaactcaaagagaaacaagaaaccttagcacaacttaagaatgatggagaacaagctcgtcttgaggaacaaagagctgatatagagtatcaacaactatcagaaaagcttgctgatttaaataaactatataatggcttgcaattaagcagcggggcgttggaacaaactacttctgaaaatgaaaaaaatcgtttagaaaaagaacttgaacaatttgctattaaaaaagaagagttgacaacttcaattgctcaaattaaggaagataaagattcaattcaagaaaaagtcaataatctaacaacattattgtcagaggcacagctagaagaacgtgatttgctaaacgagcagaaatttgaacgtgccaactgtacacgtctagagattaccttgtctgaaataaaacgtgacattagtaatttacaaacattactaagccatcaggacagtcaattagacaaagaagagcttccacgtatagaaaaacagttgctacaagtaaataatagaagagaaaatgacgaagaaaagcttgtgagtctccgttttgaattggaggattgtgaagctgctttagatgatttagctgcttctctggctaaagagggacaaaaaaatgaaagtcttattcgtcagcaagctcaattagagtcacaatgtgaacaattatctcaacaattgatgatattctcacgtcaattatcagaagactatcagatgacattggatgaagcgaaggtaaaagcaaatgtcttggaagatattttgatggcgcgtgaacaattgaaatctctacaagctaaaattaaagctttaggacctgttaatattgatgcaattgctcaatttgaagaagttcatgaacgattgaccttccttaacacacagcgagacgacttagttcatgccaaaaatttattactagagacgattacagatatggatgatgaagttaagactcgttttaaatcgacatttgaagccattcgtcatagtttcaaagaaacctttgtacagatgtttggtggaggttctgcggaccttattctgacagaaggtgatttattatcagctggggttgatatttcggttcaacctcctggtaaaaaaatccagtctttaaacttgatgtcaggtggtgaaaaagcattatcagcgttagcattattatttgccattatccgtgttaagacaattccatttgtcatcttggatgaagttgaggccgctttagatgaagcaaatgttaagcgatttggcgattatcttaatcgatttgataaatcaagtcaatttatcgttgttactcaccgaaaagggactatgtctgctgctgatagtatctatggggtaacgatgcaagaatcaggcgtttccaaaattgtttctgtaaaattaaaagaagctcaagaaatgaccaattagaaaacagaaggggatcccttctgttttttggattttcagccttattttatgttacaatagtaaatgtaaaccctttagttaggagattccatgataaaattagtagcaaccgatatggacggtacattcttagatgaaaacggtacctatgataaaaaacgtttagcaaatgtgctaaaaaaatttaaagaacaaggaattgtctttacggcagcaagtgggcgttccttattatcacttgaacaattatttgctgactttcgtgatcagatggcttttatagcagaaaacggaagtgcagcagtcttatttaatcgcttggcatatgaacagcacttgagtcgagaacaatacttagatattattgaccatttgagtaagagcccttatatggagaataatgaatatgtcttatctggcaaggatggtgcatatattctaagtgatgccaatccagattatattgaattcatcactcattattatgataatttgcaaaaagtttctcactttgaagatgttgatgatattattttcaaagtaacggctaactttactgaagagactgttagacaagctgaggagtgggtaaatcaagctataccgtatgccacagcagtgacaacaggttttaaatccattgatattattctaagctcagttaataaacgaaatggtttagagcacctctgtgaacaatacggtattagagcagaagaagtcttatcttttggtgacaatattaatgatttagaaatgctagagtggtcaggaaaagctatcgcaacagaaaatgctagaccagaagttaaagagatagcagattgtattataggtcatcacaataatcaagctgtaatggcttatttagaaagtatggtggattaatgtcggatattaaaatacttgccttagatttagatggcactttatttacaacagataagaaagtttcagaagaaaataaagtggccttaaaagcagctagagaaaaaggtataaaagttgttattacaacagggcgtcctttaaaagcaattggtaatttgttagaggacctagagttagtatctgatgaagattacagcattacttttaacggtggtttagttcaacaaaatacagggaaaatcttagctaaaactgcaatgacacgacaagaagtggaagatatccatgaggagttgtatcaagtgggtttgccaacagatatcttaagtgagggaacggtatatagtatcgctaacaagggacaccattctcaatatcatttagccaacccgctcttagaatttatagaagttgatgatttagagcaagtgccaaaggatgtagtttataataaaattgttagtgttattgatgctacatatcttgatcaacaaattgctaaacttcctgatagacttaaagttgactatgaaatgtttaaatcacgtgatatcattttagaattgatgcctaaaggtgttcataaagcagtcggcttagaactactgacaaaacaccttgggttagatagtagtcaagttatggcaatgggagatgaagcaaatgatttatcaatgctagagtgggcaggcttaggagttgcaatggctaatggtattccagaagctaaggcaatagcaaaagcgacaactatttgtaataacgatgagtctggagtcgccgaagcaattgggaaatatattttaagtgaggaaaattaatgggattatttgaccgcctatttggacataagaaaaaagataaagaaccagaaattgaagcatcagaatctgttgttttagaagatgaagattcagttattgataaagaggagggcagcaacttttcgaaggagtcaactttgaatcgaacctctgaagtccctgttgcagaagatgattctttcttagaattagaaagagatacagcattgtcagaatcacatcaaccagttacctctgaaattcatcctttagagtcagaagataccgatgaaattcctgtaaaagaagacgatagttttttagaactagaagatagggctaagacaaaggtagcagatacttctgaggtagaaaatgtagttcctgattccacgactctttctgacaatgtttctgctaaatctgaggcatcttttagtgataaggagcaattaagtgatagtcaggcttcagatcagttttcagaaactccccttcaagaagagatgtctagtggaaaaactgaggtacaaacagagtcagaggatacatctgcggctgatgcttttttagcagattactatgctaaacgtaaagcaattgagaaagaaatctcgtctaattcgctgtcaacagatgagtcagaattttctgaggcacaggaagttttatcgcaatcacaggcagacactataaaagctgagagtcaagaggaaaaatataatcgtagcctgaaaaaaacacgcacaggttttagtgcacgccttaatgctttcctttctaacttccgtcgtgttgacgaagagttctttgaagaattagaagaaatgttaatcttatctgacgttggggtaaatgttgcaacacagttaaccgaagatcttcgttatgaagcaaaattagagaatgccaagaaatcagaggatttaaaacgtgttatcgttgaaaaattagttgaaatctacgaaaaagatggtatttataatgaggctatcaatttccaagaaggtttaaccgtaatgctttttgtaggtgttaatggtgttggaaaaacgacatctataggtaagttagctcatcaatacaagtctcaagggaaaaaagttatgttagtagcagctgatactttccgtgcaggtgctgtggctcaactagtagaatggggacgccgtgttgatgtaccagttgtcactggagaagaaaaagcagatccggctagcgttgtctttgatggcatggaaaaagccgttgctcaaggcgttgatgtcttgttaattgatacagcaggacgtctgcaaaataaagaaaaccttatggcagagttggaaaaaattggacgtattattaagcgtgtcgtacctgatgctccccacgaaactttgcttgctttagatgcatctacaggacaaaatgctttaagtcaagctaaagagttctcgaaaattacaccattaactggccttattctgactaaaattgatggtactgctaagggtggtgtggtactggctattcgtcaagaactagatattcctgttaaattcattggtttcggcgaaaaaatcgatgatattggtgaatttaattcagaagatttcatgcgtggccttctggaaggaattttataagaaaaaagaactttcatttagaaagttctttttatattaaaagacacgataaacataaggattattagctttagaaacttgacgagactcttcaatgtgtaagactggtaagttttgttgtaacaattgattatactcggatttaattgtacctctaacagttacccaagtattgtccggataacttttttgatttccagtcgttagtagaccataaactcctgaatcggcaatacaatgaatgattccaaagcggaaaataaattgatatccttcgtgtttgggttcgttataaacaaacccagtatattgtatttggcgatccatgaattgctcgggatagagataaattagttccataacttccatgtaattttcagttgtgatggttaatgtaccagagcctttatattttttaagctctttttgcatttctttttcataggctgaagaagtaaaataagtgctggtatctggtttcaaatattgaacgcgtgtcccatcttgacttacagtaccagtagagccggctgctagagggaaattatatcccttggcagagactgtggttgagtctaaactaactgtaggtactaacaaacctactaaaacgggaaatactaaaatcattgggcttgttgatttagctattttaccatgtaggtgactatgcattttcatatttttaacccaaataattagctgtacaattgctaaaataaaagataggaccattgaaatataggccaaataggtataatgagtattaatatactgatttagtttacctgataactttaaatacatgcttaattcaaaataaccagcaagaataagaaatcgaatcattatattacccccacaaataaacaatagataataataataagagaagatacactaatgaattggacaataaaccttgttttaaaagaatttaccatcatcattaaattcttaatatcaatcatgggtccaattaaaaggaaagccatcactggcgcgattccaaaggttgataataaagaagcacctataaaagcgtcagcttcactacacaatgacaagatgaaagcaagcaacatcataactaagatggctgtgatagggctatgtccgatagtagtaagaactcgagttggtaaataaatttgcatagctgaagcaattaaagtaccaaatactagatagcgtcctgtatcaaaaaattcatcgatggcatgagctaaggctagaaagattttttgataccacttcttatcagaataatcatgaaaatgagtaggtttagcgtcttcttttagaatattatcatctactaaaaaggcaagcatgactcctaaagcaatggctacaatggtagcacctacaaagcgtaatatcaggaagcgtatggaatttccaaatgctgagtaggtcgcaaataaaacaataggattaataataggggcagtagcaagaaacggaactgccgtgtatgaaggcactttcttttcaaggaatcgattaataataggaatgataccacattcgcaagaaggaaagacaaagccaacgaaggttccaaataagactctgagaaatttatttttcggtaagaacttattgactatatcaggtgttataaagacttcaataattcctgataaaatagttccaagcaaaacaaaaggaagtgcctcaataataatggaaatgaaaatggcaaaccattgaaggacactatccggtaattgattaaagatatccatagaacttaatctttctgagaatcatctttctgttcaggttttgaatcagaatcaacttttttaggttttggtactttagcaaaactagcgaacatactttctaagtcatcttgacgtttgtgcgtaatagccattaatggcacctctttctttatataataacctattatactatattagcttatttttaacataaaaaaacaaatcgattggaaatgatactatatagtgataaaatgttattagtagattgatgaggtaagattatgattgaattaggtattacaacattcggagagacaacaatccttgaagaaacaaaccaaagctattcacatcctgagaggattcgccaattagttgctgagattgaactagctgatcaagttggtttagatgtatatggtattggagagcaccatcgtgaagattttgcggtctctgcacccgaaattgtcctagcagcaggagcggttagaactaataatatccgtttatctagtgcagtaacgattctctcttccaatgatcctattcgcgtctaccagcaattttcaacgattgacgcactttcaaatggtagagcagaaattatggcagggcgtggttcctttattgagtcttttccattgtttggatacgatttagcggattatgatgatttatttaatgaaaaaatggatatgttgttagcaattaactcagcgacaaatctcgattggaaaggtcatttgacacaaacagttaatgagcgaccaatttatccaagagcattacagagacagttaccaatatgggtggcaacaggaggaaatgttgattctacaattcgtattgcagaacaaggtttgccaattgtttatgcaactattggtgggaatcccaaagcatttcgtcaattggtccatatttataaagaagttggtagtcgtaatggacacaaaccagaacaactaaaagttgctgctcactcttggggatggattgaagaggataatcaaaccgctattgaccgttattttttccctacgaaacagaccgtcgataatattgctaagggacgccctcattggtctgaaatgaccaaagagcagtatttacgttcagtaggtccagaaggtgctatttttgtaggaagtcctgaagtggttgcacataaaattataggacttgttgaagcacttgagttagaccgttttatgttacatctaccagttggctctatgcctcacaaagacgtcctaaatgctatcaaactttatggtaaggaagtagcaccaattgttcgaaaatattttgaaaagaattaaagcagatctggtctgtttttttattgttagattataaaaacgctatcttgaaatcgctttttaaaactcttcgtaagtcaaaaatatgctataataaaagcgttatggaaaatttaaatattacacaaattgctattgatttaggtattaaagcgtcacaaatcgaaaaggttttagaattaacagatgaaggaaatactattccttttattgcccgttatcgtaaagaaatgacaggtaatttggatgaagttcaaatcaaatcaattattgaccttgataagagtatgacagctctttcagatcgtaaaactacggtcttagccaaaattgaagaacaaggaaagttgactcaagaactcaaaaaggctattgaagaagcaactaaactagcagatgttgaggaactctacctaccttataaagaaaaacgtcgtacgaaagctacgattgcacgtgaagcaggtctttttcctttagcacgtcttattttacaaaataaggataaccttgaggaagaagctcaaaactatcttacagatggttttgagacaactacgaaggcactttctggagcagtagatattcttatcgaagctttttctgaggataataaattacgttcatggacatataatgagatctggaactacagctcaatcactgcagttgttaaagatgagtcacttgatgaaaaacaggtcttcaaaatctactatgacttttctgaaaaaataagtaaactccatggctatcaagttttagcattgaatcgtggtgagaaaatgggtgttcttaaggttaattttgagcataaccttgaaaaaatgtttcgcttttttgctgttcgatttaaagaaactagccaatatatagatgaccttattgtacagactgtcaagaaaaaaatcgttccagctatggaacgccgtatccgtacagaactaagtgaaggagcagaagatggtgcaatttcactgttttcagagaatcttcgtaacttattgttagtctcaccgcttaaggggaaaatggtgttaggttttgaccctgcctttcgtacaggagcaaaattagcagtagtagaccaaactggaaaattaatgacaacacaagtgatttatccagttcctccagctaatcaagcaaaaatcgaacaatcaaaaatagagttagcaaaacttatcaaagaattcaatatagaaattattgctatagggaatggaacagcgagtcgtgaatcagaagcatttgttgcagaagttttacaagattttccagacgtatcctatgtgattgttaacgaaagtggtgcctctgtttattcagcctcagaattggcacgtcatgaatttccagacttaacggttgaaaaacgttcggccatctcaattgcaagacgtctgcaagacccattagcagaactagtcaaaattgatccaaaatctattggtgtgggtcaatatcaacatgatgttagccaaaaaaaattagcagaaaatcttgattttgttgttgaaactgtagttaaccaagtaggtgttaatgttaatacagcaagtccagccttgttagctcatgtttcaggtttaaataaaacaatatctgaaaatattgttaaatatcgtgaagagaatgggcaaattaagtcacgtgctgaaattaagaaagtgcccagattaggagcaaaagcttttgagcaagctgctggattcttacgtattcctaatgctaaaaatttcttggataatacaggtgttcaccctgagtcttatgaagctgttaaaaagttgcttgaccaactgactatcaaagaattagatgatcttgctaaagagaagttacaaaaccttgacttaattgcaacagcagaaagtattggggtaggtcaagaaacattaaaagacattatagaagatcttttgaaaccaggtcgtgatttgcgtgatgattttgaagcgcctgttttgagacatgatgttttagatgtcagtgatttaaaagttggacaggaattgcaaggaactgttcgaaacgtcgttgattttggtgcttttgttgatattggtgttcatgaagatggtctaatccaccagtctcgccttattaagcgaaaacgcgataaaaaaactagaaaaatgcctcctttacaacatccaagcaaatatctctctgttggtgatattgtaactgtttgggttgtagaggtagatgcggagcgtagcagaattggacttagtcttatcaagccagacggacttgactaattatgttaagaaggtgtctatagaagattttggatgtcagtttttacatactgcacattggaataatcgcttaagaacaactggaggacgcttctttccaaacgatagacaccttgactttaatcccaaaatttatcgtgagtttggtattgatatttttcgtaagattgtaagacatgagctttgccattatcatctctatatacaaggtaaaggatatcaacatagggataaagcttttaaagagttactagaaaaagtcgatggcttacgatatacccctagagttacggctgttaaagtgaattatcatcattactcttgccaatcttgcggtcaagtataccgacgtaggagacgtgttaatttacgcaagtttgcttgtggttattgtcatggtcgcttgatagagagtttttaaaatcagtcgtaaggcctatttaattttactgtcaaagtagttataattaaaatatagagtagatagaaagaaggataggtatgaaatcaagcttctacaaacaacgaaaaggtaagttggtctgcggtgttgtcgccggtctagctgataagtataactgggatttagctctttcacgggtgttgattgcactgattttgtattttaccaaatttggtcttttgctatatattttattagctgttttcttaccctataaagaagatattattgaaacaagaagacaaggtcccagaagacgtaaagatgctgaacctgttgatgatgacggttggttctggtaattcatataaaggagatttgctagatgaatctccttttttcttagctttatttagaccactttttcaaaatatcttctttttttcagaaaaacgcgttagcgcttacttttagtaaaaagtatgatataatgtgggtgtaaattaatgaaagtgtttagtacctttgctcaactttaaattgtagggtatagcaatagggatattcacttttataagaaggagtaagtatggcagttactgttcaaatgttagttgaccgcttaaagttaaatgtcatctatggtgatgaacatctattatctaagcggattacaacagctgacatttcacgtcctggtctagaaatgacagggtattttgattattatgcaccagagcgtttgcaacttgttggtatgaaagagtggtcatatttaatggctatgacaggacataatcgttatcaagtgttacgtgaaatgttccaaaaagaaacaccagctattgttgtagcacgtgatttagaaattccagaagagatgtatgaggcggctaaagataccggtattgctattcttcaaagtaaggcccctacaagtcgtttatcaggtgaagtttcttggtatttagattcttgcttagctgagaggacaagtgttcatggtgtcttgatggatatctatggtatgggtgttctgattcaaggtgattccggtattggtaagagtgagacaggactagagctagttaagcgaggacatcgtttggtagcagatgatcgtgttgatgtttatgctaaagacgaagagacgctttggggagagcctgctgagatattacgtcatttacttgaaattagaggtgtgggaatcattgatattatgagcctatatggagctagtgcggttaaagattcatcgcaagtgcaattagctatataccttgaaaactttgaaactggaaaagtttttgatagactcgggaatggcaatgaagagatcgaattatctggagttaaggttcctcggatacgtattcctgttaaaacaggccgaaacgtgtcagtagttattgaagcagcggctatgaatcacagagctaaacaaatggggtttgatgctacccagacttttgaggatcgtttaacacatttgattagtcagaacgaggtcaatgatgattaatccagtagcaatacgattaggccccttttctattcgctggtatgctatttgcatagtgtctggtatgttgttagcagtttacttagcaatgaaagaggcccctcgtaagaacattaagtcggatgatattctagatttcattctcatggcttttccactatccattgttggagctcgtatttattatgttatcttcgaatgggcttattactctaagcacccagtagagattatcgccatctggaatggcggtattgctatttacggagggttaattaccggggccattctccttgtgattttttcatatcgtcgcttgattaatcccattgattttctggatattgctgctccaggagtgatgattgcccaagccataggtaggtgggggaattttattaatcaagaagcatacggtagggcagtaaaaaatctgaattacgtaccaaactttataaaaaatcaaatgtatattgatggagcttaccgagtacctacatttttatatgagtctctttggaacttcctaggttttgtcatcatcatgtctattcgtcatcgaccgcgcactttaaaacaaggtgaagtggcatgtttttatttagtttggtatggatgtggacggttcattattgaagggatgaggacagatagcctttatttggcgggtttgcgcgtgtcacaatggttatcagttattttagttattatcggaattgtcatgattatttatcgtcgtcgtgaacaacatatttcatattattaaacagaggaggtattatgatagaaattgctgtattaattattgccattgcgtttgttgttttagttttaggaatacttttcgttctgaaaaaagtatcagaaacgattgaggaaaccaagcaaactattaaagtattaacaagcgatgttaacgtgactctttaccaaactaatgaaattttagccaaagctaatgttttagttgatgatgttaatggtaaagtatctactattgatcctctttttgtagctattgctgacttatcagaatctgtatctgatttaaacctacaggcaagacatattggacaaaaggcaagtagtgcaacctcaagtgttactaaggcaggttcagctttagctattggaaaagcggcttcaaaaatttttcgtaaaaaaggagacaaaaaatgagtaaattatttaaaactttagttatcagtgctgcatcaggtgcagcagcagcttattttttaacaacaaaaaaaggaaaagagctaaggaaaaatgcagaaaaattctatggagaatataaagaaaatccagaagaatatcatcaaatagctaaagataaagcaagtgaatattcaaatttagctgttgatacttttaaagattataaaggtaaatttgaatcaggtgaattgacaacagaggatatcgtctcagccgttaaggaaaaaagcggagaagtagttgactttgctaatgattttgtcaatcaagctaaatcaaaattctcagacgaggatactgctaaaaaagaagataaggctcctgaaacaaaagtagaagatattgtcattgattataaagaaaacacagaagataaagaaaaataaaaaagaagctactataagtagcttcttttttatgagatttttattgtctgagtgaccaaatgaatgaagagactgcagatgtaactgctagacttgccagcatcgctagtaagaaactccagacaggtgttaaacttagtgctagtaataagaaagagattagcacagtggttatactgaagagagcgatacgagcaaaaaagactagctcacgcaacttagcactgtgatcaaattcttgaaatacttgaaattttggttgagcttgctctgttttgctttcgtgagtttgctcttgcttaagtggtgatgacatagctttctcctttgatactagcatatcatatcacaaataatagagtttgtcactagttttttgatactatgagttaaaataaaggttttttctcaaaaaaacaaaaacattgcccatattagtagtagaatactaaaagtattttttactactttccttacttttttaaattggaaaagaaaaaatagatataattttatataatattacaatactatattttttcttatctgatagtgcttaacctctaaagtgatataattttcgaaaagaatatttttatttattcttgtcaagaaatatgcttaaaaatgctgaaagtttgttataatactaattatggaaaaaataattttgacagcgacagctgaatctattgaacaagtaaagcaattgctagcaataggaattgaccgcatctatgtaggggaagaaaattacggtcttcgtttaccacattcattttcagacgatgaattgcgtgaaatcgctaaattagtacatgatgctggtaaagaattgacagtagcttgtaatgcactcatgcatcaagagatgatggataatatcaaaccatttttggagttgatgaaagaaattaatgtggattatttggtagttggtgatgcaggagtattttatatcaacaagcgtgatggttataacttcaaacttatctacgacacttctgtcttcgttacatcaagtcgtcaagttaatttttggggacaacatggagcagtagaaacggttttagcacgtgaaataccttctgaagaactttttaagatgtctgagaatcttgaatttcctgctgagattttagtttatggggcttctgtaattcatcactctaagcgtccgttattgcaaaactattataattttactcatatcactgatgaaaaaacacgtgagcgtggtctttttttagcagaaccaggtgatccagaaagtcactattctatttacgaagataagcatgggactcatatttttattaacaatgatatcaatatgatgactaaagtgactgaactagttgaacatcactttactcactggaaattagatggtatttattgtccaggagataattttgttgctattgctgaaatttttgtcgaaacagctcgtttgattgaaaatggaacattcactcaggatcaggctttcttgtttgatgaacgaattagaaaactgcaccctaaaggacgtggtttagatactggattttatgattttgacccatcaacagtaaaataagatttatttgctacgtgaaagttttctatttcaaagcgtagccaattacactaagaactgcatatcgattggtatgttaattaagatagaaaataattcttttatcttgaaaatagaaggaaatataagatgtctaatgtaaaaaaacgccctgaggttttatcacctgcaggaacactagaaaaattaaaagttgctattgattatggagcagatgctgtatttgttggaggtcaagcgtatggtcttcgaagtagagctggtaacttttctatggaagagttacaagagggaataaactatgctcatgcaagagatgctaaagtttatgtagcggctaatatggttactcatgaaggtaatgagcttggggcaggtccgtggtttcgtgaattacgtgatatgggactagatgcagtcattgtttcagatcctgctcttattgttatttgtgctacagaagcaccaggcttagaaattcatttgtcaactcaagcctcttccacgaactatgaaacttttgaattttggaaagagatggggcttactcgtgtcgtattagcacgtgaggttactatggcagagttggctgaaatcaggaagaggacagatgttgagatagaagcatttgttcatggcgcgatgtgtatttcatactcaggacgatgtgttctatcaaaccatatgagccatcgtgatgctaatcgtggcggttgctctcagtcatgtcgttggaaatatgacctctacgatatgccatttggacaagaacgtcaatcgttaaaaggcgagattccagaacctttctcaatgtcagctgtggatatgtgtatgattgagcatattccagatatgattgaaaatggtgtagatagtttaaaaatagaaggacgtatgaaatccattcattatgtttctacagtaactaattgctataaagctgctgtagatgcctatatggaaagtccagaagcttttgaagctattaaagaagacttgattgatgaactttggaaggttgcacaacgcgaattagcaacaggtttctactaccatacaccaactgaaaatgaacaactctttggagctcgtcgtaaaattcctcaatacaaatttgttggggaagtggtttcatttgacaatgctaaaatggaggctacaattcgtcagcgtaatgttattatggaaggagatcgcgtagaattctatggtcctggcttccgtcactttgaatgttttattgatggtctgcgtgatgctgaaggaaataaaatagaccgtgctccaaatccgatggaattattaaccataacattaccaaatccagtaaaaaaaggggatatgattcgtgcttgtaaagaaggattagtgaacctttatcaaaatgatggtactagcaagactgtaagagcttagatacttttataactattttgtcattttacatggtcaatattactaaaaattgttaaaatagaagaagttcatttaaatagaacaaaaagctataaaaataacgaatagtataagtggaggtataaaatgtcagaatttacatttgaaattgttgagaagttattggtcctatctgaaaatgaaaaaggttggacaaaagagttgaatcgtgtgagcttcaacggagcgccagctaaatttgatttgcgtacatggagtccagatcatacaaaaatgggtaaaggtatcactttatctaatgaagaatttaaagtcattttagatgcttttcgtaaataaataaaaagtggtttcaaaaaccactttttttgtcgagacaaacgagtattcagtaaacatattgattaaaaaaatagaatttttaaactaaaagaattataatggaggtaaaaggaggcctctatgattagacattcatttaaaagtaaggtgttattgttagtctttatcttaacaataatagtgaattatttatccgcaacaggttttttaacagggaacagtcagaagagtctgtctgatcgttatcaaacgctcttgacaccagcaccattagccttttcaatttggtcagtcatctatttattgacctttttagtaatattaagagctatattcagtaagagtcaatcttaccaagataactttgctagcatttttccatactttttgggtcttctattagttaataatatatggactgtattttttacgagtaatttgattggcctatcaacaataataatttttgcttactgtattcttctggttatcattatcaagatactaagtaaaaataaatcaaaattactgcttagaataacatttggaattcatgcaggatggttgctagttgcgtcattggtcaatttagcggtctacttagttaaaattgattttaattacccattaccaaaggtatatatagctatcattgccttgatttttataactgttttaagtctttacctagctagagtattacaaaatgcttacttaatcttatccgttttttgggcttggttgatggtttttaaagcacatttagaaggaaattttcaacacctatattttagtatccaaattttatctttgattgcagcaattatccttggcgtatcgtttttcatcatcggttattataatgtcaaggagaggtacaagcaaaaaaatactagcccttactcacgggttctttgaaagaaatacaaaaagctccatcattatgtactttcctctatcattagatgtatgtctcatgatagaggttcagttcattagtggggcttttttgtattgtattaaagtaaatccatgattaatttcaaattgagtaatgttaaaatgatggcgacaaggtatgctaaataggtattccatttagcattagcatgctctcccataattgatttttgcgacgtgaaataaatcaatggaaagattgaaaatggtaaagctaaggaaagaaaaacttgtgaatagacgattagttgatctaacgtattttcttcgcctccaactagtagggcgataacaaaaattggaagaagagttaataatctagtacaaagccttattaaccattgaggtaatttgaagtgaaggaaaccttccataacgatttgtcctgttaaagtacctgtaatcgttgaattttgaccacttgctagtagggcaactgcaaaaagggtagaaaggaaagaactggctactgcaccagtaatagttttatcagatagggcaagatacatttgagaaaaggcactgatatcattagcatgcccataaaatagactagctcctaagactaatagtagcgaattcacgacaaatgcaagtgatagctgaatgttagaatctaaggtcatgaaacgtacagctttttttattgaagatttattatgataatccacgcgtctagtctgagataaagaagaatgtaaataaagattatgtggcatgactgttgcgccgataatgccaagagcgagggttaaaggactatttttcccttcatgtgatatgttaaaaagctcatggtgtggtaaaaatcctttgaacatagcatctaaatcaggttgtgataaaacaactaaatatgtaaagattatcaaaattgtcaatatgagaacagaaacaaaggcttcaattttttggacgcctaacttcattaagagtaaaagtaagaatacatccaaaatagtaatcatgatagacagtaacaggggccagccaaataataagtgaagagcaatggcagagccaatgacttctgctaaatcagtagcgataagggctaactcaatgataataaatagcaggtaacgaagcggttttgggagtcgagaagctgttgcttgtgctaagtcctgtcgtgtaacaatgccaagcttgccagccatttgttgtaattgcatcgccatcaaagaagatactaaaacaacaaacaatagtaagtaacgataggtagctccaccaataacgctagtaatccagttacctggatccatataaccaactgcaaccaaagctccaggtccaagaaaagctcttaaagtgttccaaaaagagctattgtgaggaacctcaacgctctgattaacttcggataaggatcttttgacggaatgattttgattcatgtaatactatactttctagtaatctcaagccattataacaaatagaaaatagaaaaacaattaaaaattaacgctacttaataatcaattgaggtgctgtttagtatttagagaattattttcttaacagttacatttgaaataacaaaataacagatttctatcgattatttttagttccgtagatttacctaagttatttaagtggagtaaactatatctgtagtgaattttttaagaaatataatccaataatactagcgattcttgtttgattagttcgaaagattgctttatggtatagatatactgtcttgtagagataagaatagatgagctacttaattattattttataataaaaaacacattatttttattgacaaataaaaatgagtttagtaaaataactgtcaaatagaatttcttcggggtcaggtgaaaatcctaaccggcggtatagtccgcgagctttcgagcatgaactggtgtgattccagtaccgacagtaaagtctggatgagagaagaattcagtgattgtctgctacttgcagtttatttgtgctggattaatgagagactccctatagttttctatagggagtctttagtttttttgtgctacctaaaatataatgctaattagtataatcaacgacttctcatccctccccttagttttctattttagaagctaagggtttttattttagaaggaaaaaggaaatgatgaaaaaagaagactacatggcattagccttgaaagaggctgagaaaggtatggggttcgttgctcccaacccattagtaggtgctgttattgttaaagatgatcgtataatttccaaaggttatcataaacgatttggagatttacatgcggaaagacaggctattaaaaatgctgatgaggatatctctggaagtactctgtacgtgactttagaaccatgctgtcatgttggtaagcaaccaccttgtactgaagctcttattaaatctggtatcaaaaaagtagtagttggaagtttagatccaaatcctttagtttcaggaaaagggattgccttgttgagaaaagaaggtttaaatgttgaagttggtatcttaagagaagaatgcgatgctctgaatgaaagatttatttttcacatgacctataagcagccttttgtttatttgaaatatgctatgactttagatgggaagatagctacaaagacgggcgattctaagtggatatcaaatgagcactcaagacaatctgttcagaaattgaggcaaaaatgtagtgctattatggtcggtatcaatactgtattagctgataatccacgtttaacttgccgtattcctaaaggtgaagcgcttgtgaggatcgtatgtgatagtcagttgaagatacctttagactcttacctagttaagagcgctaaaacaataccaacatggattgcaacatgttcagataatcttgctcagcaacaaacattaaaagaaatgggttgccgtttgattaaggtcccaagaaaagatggaaagctggatttgaaagtattaatgactattttaggacaagaagggattgatagccttcttattgaaggaggaagtagtttacatttttcagctttaaaagctggtattgttaacagactaattgtttttattgcacccaaaataataggaggtctgaaagcaaaaacagctatttctggagaaggtttggattggcttaaccaagctttcagagtaaaagatattgaacttagtcgtatggattctgacgttgttattgaaggaaaggtagaacattatgtttacaggaattattgaggaaatgggtcaagtcagtcgtattcggaatggcataaagtcccaacaattaagtattgatgctcccaaactagtccctttattaagaaaaggggatagcgtagctgttaatggtgtttgtttgacggttcttgacaaaagtgaaacagcttttatagcagacgtcatgccagaaagtatgatgcgaacaagcttagctgctttacgacttcattctaaagttaacttagaattagcactcagaagtgactcaaggttaggggggcattttgttcttggacatgtggatggggttggaaaaatagaaaaaatccaaaaagatgatattgctgtcagattttcaattgatgctccacctagtattatgtcttatattatagagaaaggttcggtggctctagatgggattagcttaacagtggtatcatttacagagcattcttttgaagtttcggtcattccccacacgatggctcaaactaatctatccttaaaaaaggttggggatttattaaatatcgaagtggatgttttaggcaaatatgctgagaaatttttagcacccactaatagaactaatcacacttcatcggtaatggattggtcttttttatcagaaaatggctactaagagagaggagaaagctaatggcctttagtccaataaaaaaacttttacaagacatcaaatcagggaaaatggtagtgttgatggatgacgaaaatagagagaatgaaggagaccttatttgtgcggctgaaatggtgacaaaagagtcgattaattttatggctaaatttgggaaaggattaatttgcttacctctgtctaattactatgctgaaaagttagaattagctcaaatggctagccataatactgataatcatgaaacagcttttaccatatctattgatcatctatcaactagtactgggatttctgcggaagatagagctttgacagctaagatggttgctaacgacagtagcaaagctaaagactttagacgtcctgggcacttatttcccttgttagccaaggaaggaggtgttttagctagaaatggacatactgaagcaaccgttgatctatgtcgtttagctggattaaaggaatgtggactttgttgtgaaataatggctgaagatggtagtatgatgagaaaggatgagttattagcatttgctcaaaagcacgatttagctatcgctaccataaaacaattgcaagactatagacgtcaagaagagggaggggtggttagagaaattgagattcagctaccaacgcaattcggtcattttacggcttatggatatagcgaagttgtggcaaataaggaacatgttgcccttgttaaaggggatattagtagtggtgaagatgttttatgtcgtttacactcagaatgtttgacaggtgatgtctttcattccttgagatgtgattgtggggaacaactggctaatgccctccaacaaatagaggctgaaggtcgtggagtccttctttatatgagacaggaaggtcgaggaattggtttgattaataagttaaaagcttatcatttgcaagaagaaggcttagatactttagaagctaatttggctttaggttttgaaggagatgagagagactatggagttagtgctcaacttttaaaagatttaggtataaattctataaacttactaaccaataatccagataaaatccaacaacttgaagcagaaggaatttgcgtcaaaaacagagtgccattacaggtggcagtaacagcttatgaccttaattatttaaaaactaaaaaagaaaaaatgggacatcttttagattaaaggaggaagaaaaaatgacaattattgaaggacaattagtggcaaacgaaatgaaaataggaatcgtagtctcacgtttcaatgaattgattacatctaaattattatcaggagcagtagatggactgctgagacatggtgtttcagaagaagatatagatattgtatgggtacctggtgcttttgaaatcccctatatggctagaaaaatggcattatataaagattatgatgctattatctgtcttggggtagtcattaaaggcagcactgatcattatgattatgtttgtaatgaggtgacaaaaggtattggtcatttaaatagccagtcagatatccctcatatctttggtgttctaacaacggataacatcgaacaagctattgagagggcaggaacaaaagcaggaaataaaggttatgattgtgctctttcggctattgaaatggtgaaccttgataaaaaattgcgtgagcgataaatcagaaacctaacaaagttcagtagaggtaatattaaaacccaccttaaataaggatgggttttaatatattcttatttcattgtagggaaaagtaggacgtctcggatagttgttgtatcagttaacagcatacagagacggtcgataccaatacctagtccaccagtaggtggcataccatattcaagtgcttcaacataatcgtaatcaactccagttgcttcatcatcgccaagttctttagcagatgcttgtgcttcaaagcgagatagctgatcaattgggtcatttaattctgtaaaagcattagcgtattctttagtcatgataaagagttcgaaacggtctgtaaaacgagggtctgtatcatttttcttagcaagtggagacacttcaactggatgaccaaagacaaaagttggttgaattaaagtgtcttcaacaaattcttcgaagaaggcattaatgatgtgaccaactgttgtgaaatgtttttcaagcggaacatttttttcttgtgccaaagcttgtgcttcttcaagagtcatttctttccagaagtcaataccagtgatttctttaaccgcatcaaccatatgaacacgtttgaatggttcattaattttaatttctgtgccttgataattaattggtccatcaccttttacagtttttgtaacatgctggataataccttctgtcaagtccataatatcctggtagtcagcataggcttggtaggcttcaatagatgtgaactctggattgtgggttgcatccatcccttcattacggaaaatacgtccgatttcataaacacgctccataccacctacaataagacgttttagatgcaattcagttgcgatacgaagaaccatgtcaatgtcttgtgcattgtgatgtgtgataaatgggcgagcagaagcaccaccagcttcattatgaagaacaggtgtttcaacctctaagaaaccattgctatccataaagcgacgaatttctgaaatgatttttgagcgtgttacaaaacggtcaaagctgtcacgatttgagattaaatcaagatgacgtttacgatagattgtttcaatatcagttaggccgtggaatttttcaggaagtggacggagtgcttttgaaaggtgagtaatatgagtagccttgatagaaagttctcccatatctgtacgcattacttgcccttcaacaccaaggaagtcacctaaatcagcttttttaaagatttcgtagttttcttcgccaacagaatctttacggacataaatttgaatttgaccttcgcgatcttggatatgcgcaaagccaactttccccttaccgcgcttagtcattaaacgaccagcgattgtagcagtttcttcaatgtcgtgcaagtcttcttttgatttgtcagcgtatttttcatttaattgaccagatgttgctgtacgttcaaatcgtttaccaaaaggatcaatgccttgttcagtcaaagcagccattttttcacgacgaacaatctgttggtcatttaattcttcaatatgttggttagacataatttcctccaagttagtattcatcctattgtaccacaaaaacactgataattcataatttattttatgagtttctggtgttattctcatttttaatagacttttcaccatttgaaaataagggtagaaaaaggtataattaacaattgaaaattcagaaagaaaaggataatcatgattacttcaattgtttttgatgttgatgatacgatttacgatcaacaagcaccttaccgtattgctgtggagaaatgctttcctgattttgatatgagcgctattaaccaagcttatattcgctttcgtcattattcagatattggctttccacgagtaatggctggtgaatggacaacagaatattttcgtttctggcgatgcaaagaaacgcttttagagtttggttatcgtgaaattgacgaagctactggtatttattttcaagaaatatacgaacatgaacttgaaaatattacaatgcttgatgagatgcgtatgacacttgactttttgaaatcaaaaaatgtaccaatgggaattattacaaatggtcctacggaacatcaattgaaaaaagttaaaaaattgggactttatgactatgttgatccaaaacgtgttatagttagtcaagcaactggttttcaaaagcctgaaaaggagatttttaatttagcagcagagcaatttgatatgaacccttcaactacactttatgtgggtgattcatatgataatgatattatgggtgcatttaatggtggttggcattctatgtggttcaaccatagaggacgttctttaaaaccgggaattaaaccagtttatgatgttgctattgataactttgagcaattattcggtgctgttaaagtgttgtttgacttacctgataataaatttatttttgatatcaacgataaaagtaatccagtccttgaaatgggacttaataatggtttaatgatggcagcagagcgtctgcttgagagtaatatgagcgttgacaaagttgttattttactgcgcctaactgcaaaacaagaaaaagtattacgcatgaagtatgctagataattaaataatccactagatgaatctagtggattattttagtgtgtcattttgacctcttgccttaaataagatttatcgttccaagtcagacagttgaagtctttaaaatcatgagtttctatgattgtgaggctggcattatcaagtttatctttgtagtgtaaactaccatattgataacccagtaaggaacgaatagacgcagttaggtttgctccatgtcctacaataaggaccttgtcgtaattttttgaagctagagaacgtaagaaactctctacacgatgcgttgtctgataaagagattctgcaccgaacatgtcatgtttaaattgtaagggattttgataaaatgcggtcatttgacgaggatagatagcttgcatagttgcaattttacaaccttctaaagttcccaatgcccattcacgaagttgaggagtatagtggatttcttttgggcatgaattagcatcattgaggatattaacagtatctctagcacgacctaagtcgctagaataaacagcatcaaaatgaatagatgataggtattgtccaagttcttctaattcttcaatagcttcttcaaggagaggtgagtctccgttagcaccttggaaacgcccctctaaattccattgtgtttttccgtgtctaacaagataaaatttcatatttttctccaatcctaattattattcctttatatcggcaaatttagcatttacgaaatctgcaagaacctcactattaatacgaatagaacgtccaatttctcctgcagagacaatgagttcttgtttttctaaagcgatagtatcgataaaaatagggtaattatgtttttggcgaattccaattggattatttgctccgtgaatataaccggttattttctggagatctttttgaggtatcatttgtacctttttgtttcctgaaattttagctaactttttttcggataaatgctcggtgagaggtaagatacctattatgggaccggttttatcaccgattagcgctaatgtcttaaagatatcttgtttttgaataccgttgggtaaatctccctgtaaagcatccaattgtagactatcatgttcgatttttgctttatctaaaatttgatcaactaaagtttttttgattttattctttttactcataatgacccttaactaataagtttgtttcatatttattataacatttaaagatgattatagtaaatttctactgactcttagaaataagcttgaataccatttcagggaataatgataataaatatcgcaacagtactatttggaatgttaaattagaagttttataaatagctaaatatgaagtgtcctgatgtaatgacttgaaatcataccgtggtcaggtattaaacgattactttgacaaggcatataaaaatttctatactaaatttacaaaatgaaggagagggaactatggaaatactgattgcaggtggtagtggttttttaggaaagcagataataaaagcagcgcttacaaaagggcataaagtggcttacttatcaagacatgaaggtaaaggtgatatatttaaggatcctagattaacctacattaggggagatattacagaagctgataagattcatttagaagacagaacttttgatatattaattgactgtattggagcgattaagcccaatcaactagatgagcttaacgttaaagcaacccaaaaagcagtagcactctgtcacaaaaatcaaataccaaagttagtttatatttcagccaacagcggctattcagcttacattaaaagtaaaaggaaggcagagcagataatcaaagcaagcggtctggattatctttttgtaagaccaggtttgatgtatggtgaagagcgacctctctcgattttccaagccaagtgtataaagttatttagtcatttgcctttcttaggtattgttgtacaaaaggtctttccaactaaggttgtgatagtggcagaagcaatcgttactacgcttaggaaaaaaccaacccaaaaaatcctttctattgaagaattaaataataaatagtttatcaaaaaagctactgttaacagtagcttttactcttttacttttccaaaaagtttctcataagttttcttcttgtctttattaactgcaatttgatttaaatcaagcggttgattgaatcctggtagataaccttgagaggtgtattggtgtaaatcgtatttaagttcagtttgcggagccgcttcatagtatccagaatcgctaccataagttggaatccaaacagcgtcaaatccttttacagagatgccttgctcagtcataaagtaagtaccaatgtagataccaacatttttagcaccaagtctttttaattcttttcggaatgcttggacacctttattcatgttagacattgtctcctcttctacgtcaatccaataaaaagttggtttgtaaggagctgcattcttataaaatatctgagcctcttctttcatttctttaacacttgaaccaagtgcataactgtagacagctactgggatatttcgcttttgaaattctttgatatgggtcttaaacgatttatcgattccagttgtataagcagcgttattagtcttagatatctttgatccaccaaagacacgaataacaacacctgaaatattttttgaaagcgtatcgtaatcaatctccttaggaagttgccaaccagagacatcgataatcggtttaagaacaaactctttatctttcgatgatgttgatttttgcggtacttttgaagcttttacggatggaattgtctttttagcttcaactaattcttttttcaaagtatttgtcgaatgtaaatgaccaataattaataaaagtccaaataaactgaaaaaaaccgcaacaacaataggtttaattcttcttctcattattgatattgtaacttaaaaggtttaaaaaatcaaagtttacaggcttatttacgttcttttaaaaaagaggtcgtttatgtaacattagaaatgaaattgtaataaaaaagacttttaagcggtagtcatagttttgaggtataattaaagacatgataaagaattcaactttaactaaattgactagagtcgctatattatctgctttgtgtgttgtgttgagatatgcttttgcgcctctgcctaacattcagccaattactgccatttttttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacattaaattattcttgctaacagtattcgctacaactttagtagcttgcgggcaaccatctacatcgaataagacaacaactagctcaacgttagaagttggtaaggttgaattggtggttaaagaagatacgaacgtgttaagtgaaaaggttgtttaccataaaggtgatactgttttggatgtgcttaaagctaactataaagttaaagaaaaagatggtttcattacttcaattgatggcatcagccaagatgaaaccaaagggctttattggatgttcaaggtcaataataaattagctcctaaggcagcaaaccaaattaaagttaaaaagaatgacaaaattgaattttatcaggaagtttacaaaaaataagataaaaacaagttggagatatctccaacttgtttttatgtttttgaaaggctgtagtttagccttgctcaataagattactgtaattaataatttggtctacagtgttagataagaaattaatagtatcgcgcagaggcttatcagtagaaatatcagcactgattaatagagctgtttctaaaggggtacggctcccaccagatttcaagaatgctaaccactcttttgctccgtttggattatttttgagattgagatagccggctgtcgagattactaatccagcagagtaagtatagctatagagccccatgtagtaatgagcttgtctcatccatgtcaaagcggcatcgtcatctatttcaatagcatctccccagaattgtgttaatacttccttcataatagcatttaattgttctgctccaaaagttcctccctcctcaattagagtgtaaactttacgttggaaagcagcttcaagtaagtgagtaatgaaattgtggaagtaagtatcagttaagcgatgtgcaagagcaaagcgtttttgacgtgctgtatcaaattggttttctaagtagtcactaagtaaaagttcgttaaaagtagatggagcttcaacatagtaagtggacatgtgagtattgaaaaaactttggtgattatctgagaagataaattgaccagaatgtccaatctcatgaataagtgtgtagacatcgctcatacgccccgtccagctcatgagtacatagggatgaactttgtaaggatccgcagcatatcctccagaatctttattagcgttagctgcaaaatcaacccaacgctctttttgatagcgctcaacctcttgagaatattcttttcctaaaggagcaactgatttcattactaagtcataagcatcattgatacttacttcgggattaagttcgttatcaatgtctaatttccaatctgcaaaagtcatcttttcaataccattaacatcggcgatatgtttgaggaatcgttgagctactggaccaaattcatccatgataagatcaatttgtctgtcaaacattgaacggtcaacttcttgttcggaaagaagataatcaaaaacactatcgtaaccacgcatatcagcaattaacttttcagatttgacttttgcaagataagccgcagctgcagcattttggtgcttacgtagacctttcgagaatgaacggaaggatttttcacgtatctctgcattttcgtgattttgaaagtaattttcataagttacaaaactatttttgtaggtttttccgtcaacttcaaaatcttccatatcaaaatcgccagcacgcattttagtataaatatcatatggtgtatttaggacttcatttaagtttgtcaaagctttttcgacttctggacttaataagtgttgcttttgaattttagcttggcgaatagttgctttgaaatgagggttattttctaaagaatctaaaatctttatatctgcatttgctagggcagtattaaagaaagaaagtagtacattagctttagttgcgaagtctgatcctgcttgagaaatttgtgcaaactcttcgttgctaaagtcagtagtttgaggcataaaagcatacgtatcaatgtgactcatctggatataaatatgctcgatttccataagggcactagtaaaatcctcaacacaattaagttttccctcgtaattttttttgaaaaccttgatatcctcaagagctttttcaatagccagtaaaaaatcttgacgatctttgtagagagcagtcagatcccaaagttcattttcagggaattcagagcgttttttaagtttcatgcgatactcctttaataatagttgttaattaacaattaatcagttaatctcaattatcctcagtatatcaaaaaagtcgaacaagaaaaactgattactgtcataaataagtaaaaatctgaaaattctatctaaaaatcctagaatggtttactttttactttaaaatggtatcatagtagtgagatttaagagaggaagtgatggtttgtcccacccgaaattagaaagtagtagcaataaagaaatcattaccgaagaggtcggtttactgaagcagcttttggatgaagcaacgcaaaaattgattggtagtgaatcatttgacaagattgaaaaaatagtttcattatcattaactgacgattatactggtctgaaggaaactatttcggctttaagcaacgaggagatggttattgtttctcgttacttctctattttgccgctcttaattaatatttcagaagacgttgatttagcatatgaaattaattataaaaataatcttaaccaagattacctaggaaagttatcaacgactattgatgttgtagctggccatgaaaatgctaaagatattcttgaacacgtcaatgttgtgcctgtgctaacagctcatcctactcaggtgcagcgtaaaacggtgctcgaattaacgtctaagattcatgatttattacgtaaatacagagatgtcaaggcaggaatcgtgaatcaagaaaaatggtatgctgacttgcgtcgttacatcggcattatcatgcaaacagacactattcgcgagaaaaaattgaaagtcaaaaatgagataaccaatgtaatggaatattacaaccgttctcttattaaagcagttaccaaattaacagcagaatataaggcactggcagctaaaaaaggtattcacttggagaatcctaagcctctgactatggggatgtggattggtggtgatagagatggcaatccctttgtaactgctgagacactaagattatcagctatggtacaaagtgaagtgattattaaccattatattgagcagctaaatgaactttatcgtaatatgtcactttcaataaatctaactgaagtctctcccgaacttgttacattggcaaaccagtcacaagataattcggtatatagggaaaatgaaccttaccgtaaagctttcaattttatccaagataaactggtacaaaccctactaaatttaaaagttggttcttccccaaaagagaaatttgttagtcgccaagaatcttctgatattgtaggaaggtatataaaatcacatatcgctcaagtagcttctgacatacagacagaagaactaccagcatacgctactgctgaggagtttaaacaagatttgttacttgtgaagcaatctttagttcaatatggacaagattctcttgttgatggcgaattagcttgtcttattcaagcagtagatatctttggattttatttagctactattgatatgcgtcaagattctagtattaatgaagcttgtgtagcagaattattgaagtctgccaatattgtagatgattacagttctctttcagaagaagaaaaatgtcaacttctcttaaaagaattaacagaagatcctagaacattatcttctacgcatgctcctaaatccgagttacttcaaaaagaattggctattttccaaacagcacgtgagttaaaagatcaattgggtgaagacattataaaccagcatatcatttctcacacagagagcgtttcggatatgtttgagttagctatcatgttaaaagaagttggactaattgatgccaatcaagctcgtattcagattgtaccgttatttgaaaccatcgaagatttggataattcacgtgatattatgacccagtatctacattatgaattagttaaaaaatggattgctactaacaacaattatcaagaaataatgctaggttattcagatagtaataaagatggtggctatttatcatctggttggactctatataaagctcaaaatgagctaacaaaaataggtgaagaaaacggtattaaaatcacatttttccacggtcgtggtggaactgttggtcgtggtggtggtccatcttatgaagctatcacatcacaaccttttggttcaatcaaagatcgaattcgcctaacagagcaaggtgaaatcattgagaataaatatggtaatcaagatgcagcctattataaccttgaaatgcttatttcagcttccatagaccgcatggtaacacgtatgattactaaccctaatgaaattgataatttccgtgagacaatggatggtattgtgtctgaaagtaatgccgtttatagaaatttagtttttgataatccttatttctatgactatttctttgaagcaagtccaattaaagaggtatcaagtttaaatattggttctcggccagcagcacgtaaaacaattacagaaatttcaggtttacgtgcaattccatgggtattttcatggtcacaaaatcgtattatgtttccaggatggtatggtgttggatcagccttcaagcactttattgaacaagatgaggcaaacttagcaaaattacaaaccatgtatcaaaaatggccattctttaattctcttttatctaatgtagatatggttttatcaaaatcaaatatgaatattgcgcttcagtatgctcagttagctggaagtaaagaagttcgagatgtttttaatatcatccttaatgaatggcagttaactaaagatatgattttagctattgaacagcatgataatttattagaagaaaacccaatgttacatgcaagtttagattatcgtttgccatatttcaatgttttgaattatgttcaaattgaattgattaaacgtcttcgtagtaaccaactagatgaagactatgagaagttgattcatattactattaatggtattgcaacaggtttacgaaattcaggttaatattgatagagggaggatcattgctattctcacgccaaacgcatgaagaaacttttgttttcagaaaactagattcataatgacaaaatcaatcaaagtagtacactatagatgaggtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggctaagcagatcattgatttaaaaaggaatcttttcaaaattgatgtccgggcacaaaaggatgaagagaaagttttcatgcgtacggcgtgttgctattctcccttttactttacttcgaaagatgatataatgcataatggtaattttttgatatattaaaggaaataatacaatatgaaaattgataaaaggcatcttctgaattattccatcctcattccctatttgatattgtctattctaggcttaattgtaatttattcgacaactagtgcaactctaattcagcttggagctaacccttttcgttcagtaatcaaccagggtgtcttttgggcagtcagtttggttgcaattatctttatctataaactgaaactaaattttttgaaaaattctaaagtgttgactatggcagtattggtagaagtatttttactactaatagcgcgcttttttacacaagaagttaatggagcacatggttggattgttattggtcctattagttttcaacctgctgaatatttaaaagttatcattgtatggtatttagcgtttacttttgctcgaaggcaaaaaaagatagaaatatatgattatcaagctttgacaaaagggagatggcttccgagatcactaagcgacctaaaagattggcgattttattctttatttatgattggtttggtaattgcacaacctgatttaggaaatggttcgataattgttctaacggtcattattatgtactgtattagtggtattggttatcgatggttttcagctttacttggtctaatcgtcgtggggtcaactttatttatcggaactattgcagttgttggagttgagacaatggctaaagtccctgtctttggttatgtagctaagcgatttaatgctttttttgacccatttaaagatttaacagattcaggacaccagttggctaattcgtattatgcaatgagcaacggtggctggtttggtcgaggacttgggaattctattgaaaaattagggtacttaccagaagcaacaacagactttgtcttttcaattgttattgaggaattaggagttattggtgcagggtttattttagctttggttttcttcttaattttacgtattatgcacgtaggtataaaggctaaagatcctttcaactcaatgatcgctcttggtattggagcaatgctattgatgcaagtttttgttaacattggtggtatttctgggttaatcccctcaactggagtgacatttcctttcttatcccaaggagggaacagcctcttggtactttctgtagcgatcggattcgtgcttaatattgatgctaacgagaaaaaggaactcataatgaaagaagcagaagagcaatataagccacaagaaaaaaatgaaaaaataatcaaccttgatgcctttaaataatcatccaaacaaaaatcgagatttttatctcgatttttgtattttttgaaatttaaactctaattaatagagagaagatatttgaagaaaagaagtgtctattaatattctaatactataaattaggatgtatttaacaatatgattatatgataactactaaaaaatacatataagagataacaaatgcctcaatcaatcttacccgaattttaaggaaataaagaaataagcaaaaaagcataaaatacttgcttttttagaggattttgttaaaatagataagtaaagttagactgtattgcctaccgtctatctataaaatatattttattggaggcttttcctaaaatggcaaaagaaaaatacgatcgtagtaaaccacacgttaacattggtacaatcggacacgttgaccacggtaaaactactttaacagcagctatcacaactgtattggcacgtcgcttgcctacttcagttaaccaaccaaaagattacgcttctatcgatgctgctccagaagagcgcgaacgcggaatcacaatcaacactgcacacgttgagtacgaaactgaaaaacgtcactatgcccacatcgacgctccaggacacgcggactacgttaaaaacatgatcactggtgctgctcaaatggacggagctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactagatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtactactttctcaatccgtgaaggtggacgtactgttggttcaggtatcgtttcagaaatcgaagcttaatttaacttaattaagttcccaaacggcagttagagtcagacagctcaaattgtgaagagtcctcagggactcttttttagtatctataattaaagcgttttactagactcgtgaaacttttaattaactataatttatggtatgatagattagtaaataaaaaaagaagaggtatgtgtaatgtcacgtaaaccatttatcgctggtaactggaaaatgaataaaaatccagaagaagcaaaagcattcatcgaagcagtagcttctaaattaccatcatcagaacttgttgaagcagggattgctgctccagcgcttactttatcaacagttcttgaagcagctaaaggttcagaattgaaaatcgctgctcaaaatagctattttgagaattcaggtgcattcactggtgaaaacagccctaaagtattggctgaaatgggtacagactacgttgttatcggtcactcagaacgtcgtgattatttccatgaaactgaccaagatatcaacaaaaaagcaaaagctatctttgctaatggtttgactccaatcatttgttgcggtgagtctcttgaaacttacgaagctggtaaagcggttgaattcgtaggtgctcaagtttcagcagctcttgcaggtttgtcagaagagcaagtatcatcacttgttatcgcttacgaaccaatctgggctattggtactggtaaatcagcaactcaagacgacgcacaaaacatgtgtaaagcagttcgtgacgttgttgcagcagacttcggtcaagcagttgctgacaaagttcgcgttcaatacggtggttcagttaaacctgaaaacgttgcagaatatatggcttgcccagacgttgacggtgcccttgtaggtggagcttcacttgaagcagaaagcttccttgccttattagattttgttaaataaatcacatgatatctaaaggcatagcactctaggtgatatgccttttcttatagatagttaataataagctatttttgattattgaactagtaatcagactagatttttatggctattttttgtagaatagttaaagtaaatattggtatagccaaaattaaaggagaaattttctaatggtaaaattagtattcgcacgccacggtgaatctgagtggaataaagctaaccttttcactggatgggctgacgtagatctttcagaaaaaggtacacaacaagctattgatgctgggaaattaattcaagcagcaggtattgagttcgaccttgcttttacatcagttcttaaacgtgccatcaaaacaactaaccttgcccttgaagcagctgatcaactttgggtaccagttgaaaaatcatggcgcttgaacgaacgtcattacggtggattgacaggaaaaaataaagcagaagcagctgaacaatttggtgatgagcaagttcatatttggcgtcgttcatatgatgtattgcctccagatatggctaaagatgatgaacattcagcacatactgatcgtcgctatgcttcactagatgattctgttattccagatgcagaaaacctaaaagttactttagagcgtgctcttcctttctgggaagataaaattgctcctgctcttaaagatggtaaaaatgtgtttgttggtgcacacggtaactcaatccgtgctcttgtaaaacatatcaaacaattgtcagatgatgaaatcatggacgttgaaattcctaacttcccaccacttgttttcgaatttgatgaaaaattaaaccttgtttcagaatattacttaggtaaataatctaatctttatataaaaaattcaggccaagttggcttgaattttttattatttataacattttgagtgtctgtaaaaaaccatttttatgatacaatagtagtcagagtttttatagcaaggagttaatgttgaatcgtaaaaaaaggtatcgtctcactgtaaaaaagcaaaatgctagcatacctagacgattaaatcttctattttttattattgttttattatttactgttctaattcttcgtttagagcaaatgcagattgggcaacaatcattttacatgaaaaaactgacagctcttacgagttatacagtgaaagaatcaaaagcgagaggtcagatttttgatgctaagggagttgtcttagttgaaaatgatgaacgtcctactgtggcgttttctagaggaaacaatatttcatctcagtctatcaaagagttagcgaataaattatcacattacattaccttaaccgaagttgcttcaagcgatagagcaaagagagattattatttagcagataaagccaactacaaaaaagttgttgaaagtttaccagattctaaacgttacgataaatttggtaaccatctagccgaatcaaccgtatatgcaaatgcagttgctgcagttccagtgagcgctattaactattctgaagatgagttaaaagtggttgccttatttaaccaaatgaatgcgacaccaacgtttggttcagtgaaattaagtacaggcgaattaagtgatgatcaaatcaagaaactggatgctgataagaaggaactgttaggaatttctgtaacaagtaattggcatcgtcgtaaaaaaggaacttctttatcggatatattaggtactatttctacagaaaaggcaggtttaccaagagaagaagttaaaaaatatttgaaaaaaggctattcactgaatgaccgagtgggaacttcttaccttgaaaaacaatatgaagatgacttacaaggaatcagacaaattcgcaaagtagttgttaataaaaaaggtaaagttgtttcagataatattacgcaagaaggtaagtcaggaagaaatcttaaattaacgattgatcttaattaccaaaacaaagtagaaagtatcttgaaacaatactatggcagtgaattatctagtggacgcgctagtttttccgaagggatgtatgcagttgctatagaaccttcaactggtaaagtgttagcaatggctggtctgaaaaatgatcatgggaatttagttgatgacagcctaggcactattgctaagaatttcacgccaggatctgttgtgaaaggtgcgacgctatcatcaggatgggaaaataaagttcttagaggaaatgaagtgctttatgaccaagaaattgctaatatacggtcatggtttacacgaggtttgactccaatatctgcggcacaagcgctagagtattcatctaatacttatatggttcaagtagcacttcgtttaatgggacaagactataatacaggagatgctttaactgatcgaggctatcaagaagcaatggctaaactaaggaaaacttacggcgaatatggtttaggggtttctacaggattagatttacctgaatcagaaggttatgtacctggaaaatacagcttaggaacaactctaatggaatcgttcggtcagtatgatgcctatacaccaatgcaacttggtcagtatatctcaactattgcgaataatgggaatcgtttagcacctcacgtggtttcagatatctatgaagggaatgattctaataagttcgctcaattggttcgttcaatcactcctaaaacactaaataagatagctatctcagatcaagagttagccattattcaagaaggtttttataacgttgtcaatagtggaagtggctatgcaactggtacgtcaatgagggggaatgtgacaaccattagtggtaaaactggtaccgctgaaacatttgctaaaaatgtaaatggacaaacagtttctacctacaacttaaacgctattgcctacgatactaatcgtaaaatagcagtagcggtaatgtatccgcatgttacaactgatacaacaaaatcccatcaattagttgcacgagatatgattgatcaatatatttcacagttcacaggacaataagagaggacatttgaatgctttacccaacaccaattgctaaattgattgacagcttttcaaaattaccgggtataggtactaaaacagcaacacgtttagctttttacaccattggtatgagtgatgaagatgttaatgaatttgctaagaatttattagctgctaagcgggaattaacctattgttctgtttgtggtaatttgactgatgatgatccttgcttaatttgtacagataagacgcgtgaccagtctgttatcttggttgttgaagatagtaaagatgtgtcagctatggaaaaaattcaagagtataatggtttgtatcatgtcttacatggcttaatttcacctatgaatggtattagccctgatgacattaatttgaaaagtttaattactcgattgatggatggtcaggtgacagaagttattgttgctaccaatgcgactgctgatggtgaagctacatcaatgtatatttcacgagtcttaaaaccagctggtatcaaagtgacacgattagcgagaggtttagctgttggttcagatatcgaatatgcagatgaagtaaccttgcttcgagcaatcgaaaatcgtacagagttataattgttataaagaaaaggttgggaatctcctaactttttcttttacaatactaactttaagtggattgatttttgaaagttaggttaaaatatggtattattaaaaggtcaatcttagattagatagaaaagagaagaaatatgtcaaaagaaacattgatcttgctttacggtggtcgctctgcggaacgtgaagtatctgtactgtctgcagaaagcgtcatgcgtgctattaattatgataaattttttgttaaaacttattttatcacgcaagtaggtcaatttattaaaacacaagaatttgatgaaatgccatcttcagatgaaaagttaatgacaaaccaaactgttgatttagacaaaatggttcgtccaagtgatatctatgatgataatgcaattgttttccccgttttacatggaccaatgggggaagatggttctatccaaggatttttagaagttttaaggatgccttatgttgggactaatattctatcttcaagcgtggctatggataaaattacaacaaaacaagtccttgcaacagtaggtgtacctcaggttgcatatcaaacttattttgagggtgatgatttggaacatgcgattaaactctctttagaaactttaagtttcccaatttttgtaaaaccggctaatatggggtcatcagtaggtatttcaaaagcgacagatgaatcctcacttcgctctgcaattgacttagctctcaagtatgatagccgtattttgattgaacaaggcgtgacagctcgtgaaattgaagtaggtattttaggcaataatgatgttaagacaacttttcctggcgaagtcgttaaagacgtcgatttctatgactatgacgccaaatatattgataataaaattactatggatattccagctaaagttgatgaagcaactatggaagcaatgcgtcaatatgcaagtaaagcttttaaagcaatcggggcttgtggtttatcacgctgtgatttctttttgacgaaagatggacaaatcttcttaaacgaactgaatacaatgcccggttttactcagtggtcaatgtatcccctgctttgggaaaatatggggctaacttatagtgatttgattgaaaagttagttatgttagctaaagaaatgtttgaaaaacgtgagagtcatttaatttaaaaaagttcaactaagtctttcttagttgagctttttcaaatctatgatatgttatgaaagtgtgttataatttaggagtatattcgtttataagggatagcatactatctacaacattgttgctaaataatagaaaaggaaatgatatgaagcttagtttgcatgaagttgctaaagtagttggcgctaaaaatcaagtatcagagtttgaagacgttcccctgggaaatattgaatttgatagtcgtaatatcagtgaaggtgacttatttcttcccttaaaaggagcaagagatggacatgagtttatagagatggcttttgataatggagcaatagcaaccatttcagagaaggaaatagagggtcatccttatcttttagtgtctgatgcacttaaagcatttcaagtcttggcacagtattatattgaaaagatgaacgttgatgttattgcagtaactggctcaaatggtaagacaacaactaaagatatgatagctgcaatcttatcaaccacatataagacttataaaacacaaggaaactacaataacgagattggcttaccctatactgtgctacacatgccagaagatactgaaaaaattattttggagatgggacaggatcatcttggagatatccatgtgttatctgaaattgcaaaaccacgtattgctgttgttactttgattggtgaagcacacttagaattttttggtagtcgagaaaagattgcagaagggaaaatgcaaatcacagatggtatgagttcagatggcatattaattgcaccgggagatccaattattgatccatatcttccagcaaaccagatgactattcgttttggtcatgaccaagaattgcaagtgacagaactcaaagaagaaaaacattccttaacttttaaaactaatgctttggagcaccaattacgtataccagtacctggtaagtacaatgcaactaatgcgatggtcgctgcctatgttggaaaattattagcagtagcagaagaagatatagtggatgctctagaaaatcttcaactaactcgtaatcgcaccgaatggaagaaatcagccaatggagcagatattttatcagatgtttacaatgctaacccaacggctatgcgattgatactagaaaccttttcagctattcccaataatgatggtggaaagaagattgctcttttagctgatatgaaagaactgggagaacaatctgtggatttacataatcaaatgattatgagtatcagacctgactctattgatactttgatttgttatggccaggatattgaggggttggctcaattagcaagccagatgttcccaattggtaaagtgtatttctttaaaaagaatcaagaagtagatcagtttgatcaattgcttgcaaaagtaaaagatactcttaaggagaaagatcaaatattattaaaaggttctaactcaatgaatctttctaaaatagttgatattcttgaagtaggataatagaggtgttagggtaacaagttaccctaacttttttgttttttaatcacgaataatattcagttttattgaggaaaatagatatgctaagcagaaaactggtgatatattcagttttttgataatctgtttattacgaactatatttttaaaaataaaacttaagttcgtttttaggaggattgtttgaaaaatttaaatcgttatgtagttgcggtttctggagtcgttttacatttaatgctaggatcaacttatgcttggagtgtgtttcgtaacccaatcatctcagagactggttgggatatttcatcagtttcattcgcttttagtttggctattttttgtctaggaatgtctgcagcttttatgggacacttagtagagcgttttggtcctaggataatgggaatgatttctgctattttatatggagcagggaatgtgttaacaggtttagccattgaaactcagcagttatggttactgtatgttgcatacggtattttaggaggaatcggacttggttcaggttatattactccagtatcgactattattaaatggtttcctgataggaggggactagcaacaggattcgctattatgggatttggctttgcttctttagtaacaagtccgcttgcacaatccttaatgattaggattggtgtaggtaaaacattttatattttgggattagtatatttttttgtcatgatgattgcctcacaatttattaaacaaccacctcaggaaaaaataactattttgactcacgacggtaaaaagaatgctatgaattcacaaattattactggattaaaagcaaatgctgctataaaatcaaaaaccttttacatcatttggttgactttgtttattaatatttcgtgtggcttaggtttaatatcagcagcttcaccaatggcacaagatttagcaggctattccgcagaatctgcagccttattagtaggggtactagggatatttaacggttttggacgtctgttatgggcaagtctctctgactacattggacgcccgttgacctttataatattatttattgtgaactttattatgacttctagtttatttttgtcattcaatgctattgtatttgcaatagcaatgtctattttaatgacttgttatggtgcaggcttttccttattacctgcttatctaagtgatatttttggaacaaaggaattagctactttacatggttatagtttaacagcatgggcaatagcaggtctgtttgggcccctattgttatcaaagacatattcatggggaaattcctatcaattgacattaatggtttttggttttttattcttattcggattattgttatctctatatttaagaaaattaacaactaaagttgtgtagtatatatctaatttaaaattctttggttttaccaaagagttttttctttgaaaaatagttttgtcttatagcaaataatttgatatactaagtatctagtaaaaaaatgatagaaagataatactaaaatgatagaattcttttctaatatcagaacagagattccgcagatgcctttacttatccatagtttgattttatctgtcttaccttttctgatgtggctgactttggttaatagagataagcctttgtataaaactatttggagtatccttttaggacttcagttaattacgatttatacttggtttttctgggcaaaattgcctttatctgaaagtcttcccctttaccattgtcgaataggcatgtttgtcgttctcttggcgaggcctggaatattaaaggattatttcgcattgttaggagtagtaggtggagtattggcaatgattcacccagacttttacccttaccagtttctacatgtgactaatattttcttctttattggacattttgctttatttgtccttagtttactacatctgatgacacagtccaatttggacaaattaaatccaaaattgattatacaactaacgcttctcattaatatgtctttgatttttattaacctcttgactggggggaattatggctttatgatgaagacaccaatactaggaataacaaatccctttttaaacctttttatagtgacaactctattaagttttctcgtcctatttgttaaacaaattttccaaaaagtgagaatgagagctagtcttaaaacagaagaatcttaattattttaatattattatattatctagctattaaaaaataaatagctggataatgtttttcatttttagctatttttatgattgaccgctaattattaatctgctaagatatagtacgtaataaaaacttaaccggttaattatttttgaaatatattttttctggaggaaaatagtaatgaataaatcattcaataccaaattaggtttggtaactgtagcggtattatcaggtattgtattaacgtctcaattacctgtgaacgctaaagctgagacaccagtaatggcagcaagtgcacaacaaggtttccgttttgtagcaaccgttgtagatagtcagacgcatgtcttgccgggaaaattggtaactttgtcagaggtgacaagtggtcagcctaaaattattgcaagtgtgaaaacgaatgatgccggacaagctatttttaataatctccctataaaacgtaaccttagtgtgtctgttgatggacaagtaaaaggatatactattcgaactgacgtagcaggttctagtaaagcagctagttttacagcaacaggagtagggacaaatgagccaacgtattcaaaaaaaaccatagacatcacagtgagagaccagaatgctgaacctgtttcaggcaggacagttaccttaaaaacacaagctggtcgtgagattgctagcttggtttctggtgacaatggattaactcgctttactgatcgtttactagatggaacattctaccaatattttgttgatgggaaaaaaattggtgatattgtacctggagaatcaagaagtgcatatgttaatgttgcacctaaaaaagattattttacctttacagtcactgctttagataaagatggacttgttgttaagggaaaagaagtaacgttgactgatattactgatggtaaagcagtagcgcttgcttctttaaaaacgaatgataatggacaagctatctttaccaacctaccattatcaagaaatatcagtgtttcaattgatggaaaatcaaagggctatactcttcgaactgatgtagcaggctctcataaagcggctgcattctatgtagatggtaaaggtaccaaagcacctcaatttagtgcagaagcagcggttgtaactgtttacgatgctaatggaaatactatagcaaaccaagaagtgacattaactaattcaaatgggacaattgttgcaaaaggtttgactgaaaaagatggcaaagcaaggttcgccaataaattaatggcaggaacgttatacaatatttttgtaaatggtattgagatgcctaaaactgcccttgttggtagtgatgtcagtgtttttctaacagataaacaaattaagaaagaaaaacctgttactcctgataaattggataaagaaatgaaccaagagaaggaaaaggagctcttagatactccaaaaccagtaccacctacttcgaaaccaacagcaccaattaaaaataaaaaggacgattcccctaagaagttcacgaaaagtcaatcttctagtttgaagtcaagtgttaaggctataggtgctaagccaaaagctatgacagccttagctaaaaaattgcctaaaactggtgatcaagccattagtattttaactttggttggttttattgtaacagggttagcgattatgttaggcttccttaaaaaatcacgatcaaaataatttattttagaagcttgggtctttagacacaggcttctcttctttcttcggaaatagattgaacttgaagaatgttgttaaattcgctataataataaagttatagacaagattattgtttcagttgagactactgaaaataatactaagaaatggataaaagctaaggattgaatatgacattacaagacgaaatcaaaaaacgccgtacttttgccatcatctctcacccggatgctggtaagacgactattactgagcaattattatattttggtggtgaaattagagaagcagggacagtaaaagggaaaaaatcaggtacttttgcaaagtccgactggatggatattgaaaagcaacggggtatctctgttacttcatctgttatgcaatttgattacgcgggtaaacgtgttaatattttggatacacctggacatgaggatttctcggaagatacataccggaccttaatggctgtggatgcagctgtcatggttgtagattcggctaaaggtattgaggctcaaactaaaaaactttttgaagttgttaagcatcgtaatattccggtttttacgtttattaataaattggaccgtgatggacgtgagccattggatttgcttgaagagttagaagaagtactaggtattgcttcttatccaatgaattggccgattggtatggggaaatcatttgaagggctttatgatttacataataaacgtttagaactctataagggagacgagcgttttgcaagtattgaagacggtgatcagctgtttgccaataatccattttatgaacaagtcaaagaagatattgaacttcttcaagaagcaggtaatgacttttcagaacaagctattcttgatggtgacctaactccagtattctttggctctgcccttacgaactttggagttcagacttttcttgatactttcttggagtttgctccagaacctcatggtcacaagactacagaaggtaatgttattgaccccttggctaaagatttttcaggttttgtctttaaaattcaagctaacatggacccacgtcatcgcgaccgtattgcttttgttcgtattgtttctggtgaatttgagcgcggtatgggagttaatttgacacgtactggtaaaggtgctaagctctccaatgttactcaatttatggcagaatcacgtgaaaatgtgacgaatgctgttgctggggatattatcggggtttatgatacaggaacttatcaagttggggataccttaacagttgggaaaaataaatttgaatttgaaccattaccaacttttaccccagaattatttatgaaagtatcagcaaaaaatgttatgaagcagaaatcattccacaaaggtattgagcaattagtacaagaaggagcaatccagctttataagaattatcagacaggcgaatacatgctgggtgctgtgggtcaacttcagtttgaagtttttaaacatcgtatggaaggtgaatacaatgctgaagttgttatgacaccaatgggtaaaaagactgtacgttggattaactcagacgatttagacgaacgcatgtcttcaagccgaaatattttagcaaaagatcgttttgaccaaccagttttcctatttgaaaatgattttgcacttcgctggtttgctgataagtatcctgatgtgaagcttgaagaaaaaatgtaaaatttaaagtcactcaaatttgagtgactttttaagttttttagactaaaatagttataatacatagaaaagattggagattaacatgggaattttttcgggattaatgggaaatgcttcacaaatggataccgataaagtcgagaatcagttatctgatattctgatttcagatgaacaggttgatttagcttataccttaattcgtgatttgattgtttttactaattatcgtttaattttagtcgataaacagggggtgacaggtaaaaaggtttcttataattctataccttatgcttctatatcacgttttacagtggaaactagtggtcattttgatttagatgctgagttaaagatttggatatcatcagcaatagaaccagcagaagtacttcagtttaagaacgaccgtaacatagtgagtatacagaaagctttggcgacagctgttttaaaataaacaatttagcagtagtgatttttatcactgcttttattttgaagtatagtaggcctcaagcatatattttgaaaacgctgtatttttttgataagatatttttttgaggagtattaaataatgataatagaattaaagagtgttggaaaaatttttccaaaatcacagtttagattagatgatatttcttttaatatagaagaaggcgagatagttggtctgattggttctaatggtactggaaagagtactattttgaagatgattaatggcttaatcccttatgataaaggaaatatttattatcaaggaaaagaagtgaagtctttttctgataataagttacgtcagatgcgtaaagatattgcttatatttttcaaaatcataatttgttagcaggagaaagtgtatattatcatctagctttagtttataaattaaatcatcaaaaagtaaatcatgacgcaattaatgatatcttagattttttaggtttgatggatttaaaacaggtgaaatgccatagtttgagtggtgggcagcaacaaaaagttgcaatcgctatggctgttttgcaaaaaccgaaacttattctatgtgatgagatcagctctgccttagatactaatagtgaaaaagagatatttaacttgttgtctgatcttcgtgaaaaatatggtatctctatcttgatgattgctcatcacctatctcttttaaaacaatattgtgatcgtgtaatgattttggatcaccagactattgtagatactgttgttccagtgaaagcaactctgaatcaattaaagtcaaactacgtagatcaagtaaaggagtttttgttacatgattgacattattgaaaaacatggcgaaggtatcttaaaatcattttgggaaaccaatttaatgttagggttaaccttgattctttgttttctaattgcttttccaacaggtattttattgttttcattgagaaagtcttacttgattaaacattctttagcctatcaactactaaatttatttttaggtacgttacggagtgtccctttccttatttttatttttatcttaatccctctcaatcgattaatttttgggacctcatttggaacgatagcggcaatcttacctcttactttggtttcagtcagtttgtatgcacgttatgtggaacaagctttattaaatatacctcaagttgttgtagatcgagctctcagtctaggggctaacaagagacagataatttattattttttaatcccctccatcaagattgaccttgttttatcatttactgcaacggctataagtattcttggctactcgacaataatgggagttattggtgcaggaggtttgggtgaatatgcctatcgttttggctatcaagagtatgactacccagttatgtacttgattgttgtcttatttataatatatgtgtttatcttacagagtttgggctattttatagcaaaccgctactcaagaaaataaaagaaaagaggaactatgaaaaaattactttccctaacatgtctaatcatgatgtctttatgtttagtggcatgtactaagcaagcaatgtcgtctaagaaaattaaagataagaatagtaaagaaaaggtgattactgttgcaacttacagcaaacctacatctacctttttagatttggttaaagataatgtaaaagaaaaaggatatactttaaaggttgtcatggtctctgactatattcaggctaacattgctttagaaaacaaagaacatgatgctaaccttttacaacatgaatttttcatgagtatctttaataaggaaaatgatggtcatctagtatcaattacaccaatttatcattcattggctggtttttatggtcaacatttgaaaaatattgccgagcttaaagacggtgctaaggtagcgattccgtctgatcctgccaatatgactagagctctgctattattgcaagaaaagaaacttatcaccttaaagaatacgtccaaaaagaccaaggctatcgaagatattattactaaccctaaaaaattacgaattgaacctgtagcattacttaacctcaatcaggcctattttgaatatgaccttgtctttaatttccctggatatgtgacaaaaatcaatctagttcctaaaagggatagattattatatgagaaaaaaccagatatccgttttgcaggtgccttggtagctcgtgaagataataaaaatagtgataaaataaaagtacttaaagaagtactaacaagtaaagagattcgtcactatatcactaaggagattccaagtgaagcagccgttgcgttctagatagataaactatgaaccctccttctttatagatggtgggtttttattgccttttttctattttctgaagcaactaatagaactagcaatttatgaaagcgtgttatttattagattgaccttattttatatctttttacttttaattgtgttacactaagtaggttgtcagaaaagataactaataaaggttcataaggcagcttcgcactgtcttttagaaaagagaaacatttgaaatttacagaacttaacttatcgcaagatattctttcagcggtagaaaaagcaggctttgtagagccatcaccaatccaagaaatgactatcccacttgctcttgaaggcaaagatgtcattggtcaagcgcagacaggtacaggaaaaactgcagcttttgggttaccaactttaaataaaattcatactgaagataatactatccaagcacttattattgctcctacacgtgaacttgcagtacaatcacaagaagaattgttccgttttggacgcgataaaggtgttaaggtccgctctgtttatggtgggtcaagtattgaaaaacaaatcaaggcattacgttcaggagcacacgttgttgttggaactccaggtcgattacttgatttaattaaacgtaaagcacttaaacttaatcacattgaaactcttattcttgatgaagcagacgaaatgcttaacatgggatttttagaggacattgaagcaatcattagtcgtgtaccagaaacacgtcaaactcttttattctcagcgacaatgcctgatccaatcaaacgtatcggcgttaaattcatgaaagatcctgagcatgttaaaattaaagcaactgaattaactaatgtgaatgttgatcagtattatgttcgtgttaaggaaaatgaaaaattcgatactatgacacgtttgatggacgttgatcaaccagaattgtcaattgtctttggacgtacgaaacgtcgtgtagatgaattaactcgtggactaaaattacgtggtttccgagcagaaggaattcatggagacttagatcaaaataaacgtcttcgtgttatcagagactttaaaaatgaccatattgatattcttgttgccacagatgttgctgcgcgtggtttagatatttcaggcgttacacatgtttacaactatgatattccccaagatcccgaaagttatgttcaccgtattggacgtactggtcgtgctggtaaatctggtcaatctatcacttttgtttcaccaaacgaaatgggatatttgacaattattgaaaacttaactaaaaaacgtatgactggaatgaagcctgctactgcaagcgaagcatttcaggctaagaaaaaagttgcattgaaacgtattgcacgtgactttgaggatcaggaattagtttctaaatttgataaatttaaagccgatgctttagaattagcaactcaatacacaccagaagaacttgctctttatgtcttaagcttaacagttcaggatccagaatcgttaccagaagttgaaatcacacgtgaaaaaccattaccatttaaaccatcaggtggtggctttaaaggtaaaggtggacgaggcaatggccgtggtggcgatcgtcgacgcaatgatcgtggtgatcgtcgtggaaatcgtgaccgtgatgatcgtggtagtcgttgtgattttaaacgtcgtgatgataagttcaagaaagataatcgtcgtcaagaaaataaaaaacctcataaaaacacttcaagtgaaaaacaaactggatttgttattcgcaacaaaggcgataaataagaggattatgaaaaaggagttgctgagcgactccttttttattttttgtaagataaagcgtagatagtgatatccataaaattgccttataactttaagaatgaagacaaaagattaaagtgaggttgaaatttaaaagttaaagaagcgaggataggctcattacacttagtatattatcgtattattgttcatttttatgttgtttaatataagtcaattttgcttgccgagtcttttgtttaaataatgcttctgccctcattgcttcttgtttgctattaaaagcttcagaataaagaagttttactggcaatctcgcacgagtatatttagcaccttttccagtattgtgtgtattgagacggcgcttgacatctgtagtataacctgtataaagtgttccatctgaacattctaaaacatacatataagcaggaactttaatcatgagattttccgttttctccgaaatatatatcaaaaatagtctcagtatagtctccattatcttgatgaacaacaagaggaggaagtattttcataccttctgtcgagccatctttaatagcttcaattaaaagcatattagcatcttttcctaattttggataaacaaattggatacgtttaggtgctaaattgaactgacgcatcgtatcaataatttcaaggaaacggtctggacgatgtaccatagcgatacgtccttttgtttttagagcatgttgagcaatttgacaaatctctctaaggtttgttgttatttcgtgtcttgcaaggagataatgcgggcttagattttttttagaggtttcgcttgctttgaaataaggtggattgcaaagcattaaatcaacgtttgaacgttgaacatgatcaagaagattttttaaatcatcattaatcatagtaacctgtttttccaatttattgagcttaatcgaacgcttagccatatccgcaaggctctcttgtagttcgatctctataattgtcgcatttgttttggtgctggcaaacaaaccgacagcaccattaccactacataagtcaacgataagaccacgagaaggaagtttagggaaccgagacaataaaacactatctatggaataggaaaaaacttctttgttttggatgattttgacatcagttgaaaaaagctgatcaatgcgttcattttcttttaaaattgtatctatcataggcttattatagcaaaattacagcttcctagcactagttttgaaagtgtggaggttgattttaagataattctttctaaaaaaaaggaagcatgataaaatagaagttacttgatgaaaggtagaggagaaacatgttctatacttacttacgtactttagttatgttcttgatttgggtggctaatggtaatgcgcactatcataatgaagataaaatgttaaaagatgatgaaaattatattttagtagctccacacagaacattttgggatcctgtgtacatggcttttgctgctagacccaaacagtttatttttatggccaaaaaagaattattcacgaatcgtttgtttggttggtggattaaaatgtgtggtgctttccctattgatcgtgaaaagccagggcaagatgctattcgatatcctgtaaagatgctgaaaaatagcaaccgttctttggtgatgtttccgagtggaagccgccactccaaagatgtcaaaggaggcgtagctgttattgcaaaaatggcaaaagtcagaattatgccagcagcatatagaggtcctatggtttttaaaaatctattaaaggggcatcgtgttgatatgaattttggtaaccctattgatgtttctgatattaagcgtatggatgccgaagggattgcagaagtatctcgtcgtattcaggaagaatttgatcgtttagatagagaaaatgaaacttatgatgatggtaagaaattaaatccattgacttatatttatcgtctacctttagcaattatagctattgtcttgcttgtcctaactctaatttttagttatttagcaagctttgtgtgggatccacaaaaacatctaaaataagggttacatggaaactatttactttttagtaaatagtttttttggtttttaataggaaaatctctttagttacgaataagtaaatggaggaatatttttatgtttgaaatagtattggaaaaaattaaatcgcataaatgggagacaacaggaattattgtaggactcttattatttggaattttgggtttaaatcattttggcactcatcataaagaagacaatttaaatatcaatttagagaaaaaagtatcaactataacagaaaaaaaggtaccaatgattagtcacgtcaaagataaagtatctaatcaagtaacggttgacgtaaaaggggcagtcaatcatccaggtgtttatagtttgccttctcaaagtcgtgtaacagatgcgattaagcgtgcaggtggactaagcaatctcgctgatagtaaatccgttaatctagcacagaaattacaagatgagacggttatctatgttgctcaaaaaggtgaaaaaataactgttgtggaagaggagaaagcaaataatatcgctactcagggaaatagtaaggggaaaattaatcttaataaagcagatttatcaagtcttcagaccatatcaggcgttggggctaaaagagctcaagatattttagattatcgtgatagtcaaggtggttttaaaactattgatgacctcaaaaacgtatcaggtattggtgagaaaacactagaaaaattacgtcaagatgttacaattgactaagtattttcctctaaaacctatttatttagcattgttggtcttccaaatttacttactagtgttttcttggacaatgcttggttgtgcctttcttttattttcttttatttttctgatttatcaatatgatcgtgaaactatttttaaaacaatagcaatagtaatttttttcttattttattttttatggcaaaatcacaatatgaatgtccaatatcaaagagtaccgaatcatattagccagattaaagtgcgtattgatactatttctatcaatggtgatgttttatcattccaggcagatgcttcaggtaacacttatcaagctttttacacattaaaaaataaaagtgagaaagattattttcaaaatcttgataataatataatgataattgcagatatcaaacttgaagaagcagaggagagaaggcattttaatggctttgattatcgtcagtatttaaaaagacatggaatttatcgtatcgccaaagtgacaaagataaaacagatacgcttatttcaacataggtctttctttgctcttatgtctaagtggcgtagaagtgcaattgttattagtcaaacttttccaaatcctatgcgtcactatatgtcagggcttttgtttggatatctagataagacctttgatgacatgtccgatttatatagtagtctaggtattatacatttatttgctttgtcaggtatgcaagtaggtttttttctcggtatttttcgttatatctgtctacgtattggcttacgtctagaccatgtttggttacttcaaataccattctcgctaatttatgctggtttaacaggctttagtatctcagtcgttagggcacttattcaatctttattatcacatagcggtgtcaagaaagatgagaactttgctctctgcttgttaatttgtcttatctccctcccccactcacttttgactacgggaggagttcttagctttgcttatgcttttatacttacgatgacctcctttgatcatttttcgagtataaaaaaagtagctatcgaatctttgacagtctctgtaggaattcttcccatactaacctactatttttcgggttttcaaccaatatcaattatattaacagcacttttatcttttgcatttgatattatatttttgcctttattaactgttatatttgtcttatcgcctatcgttaaattaagttgtattaatagtttgtttgaaatcctagaagtgttattaaaatggactgggcaactgtttccaaggccacttatttttggaaagcccagcctttttcttttaatagtcatgattataattttgggattactttatgattattatcattctaaatgttttcgttattgctcccttcttattatctttaccttgttttttatcactaagaatccaattactaacgaggttgcgattttagatgttggacagggagatagtattttagtgagggattggttaggaaaaacaattttaattgatactgggggaagggtgagatttgaacagcctgaagaatggaaacaaaaagtaaatcagtctaatgctaagagaacgctcattccttacttgaaaagcagaggtattagcaagatagatgatttagtgataactcataccgatacagatcatatgggggatatggaagttatctcaaagcattttaaagttgcacgtttgattacaagttcaggttctttaacgaattcgcagtacgttaagcatttatcaaagataggtgtagcggtaaaatctatagaagccggtgataaacttgctgtcatgggaagttatttacaagtactttacccatggcacaagggtgatggaaaaaataatgattcaattgttttatatggacatttattaggaaaaggcttcttatttaccggtgatttggaggaagagggagaaaagcagttattagaagcttatcctaatttatcagtagatatccttaaagcaggacatcatggttctaagggctcatcaagtctatcctttctgaaaaagttgtctcctagtgtggttctagtttcagctggtaaaaataatcgttaccagcatcctcatcaagagactttacaaaggttccaaaagattaaaagcaagattttccgaacggatcaatcaggtacaattaggctaacaggatggtggaagtggcatattcagacagttcgttgatttataaaaatgattgcgtatctgttaaatacaatctatttttcgcaagaattcagtaattttaagcttgacatggaacgggttccagcatttatactgatttcagaagaagagaggtattttttatgactatcaaacgtattttttgtgacatggatggtacactattaaatagtgaaggacaagtgagtaaaagtaacgctaccttaatacgtgaggcagcgattccagtaactttagtgtctgctagggcacctatggaaatgaaggatgccgtagatgcacttcaattaggaggagtccaagttgcttttaatggaggattgatttatagaataggagataataatcaagttctacctattcatacacaaatcattaaaaaaagcacagtaaaacaattgctaagaggaatacggtttcattttcctcaagttagtttatcttattacgatcttaataactggtattgtgataaaatagatgaaggaatccgatacgaacatagtttaactcaacaatgcccaacgtttattcataatgaggatcagtttttagaaggtcacacaaatacttttaaaattatgatgattactttcgatgaagcaaatatgctagaattagaaaaatatcttcaaagtttggagttaccagaaatcactattcaacgttcaggtaaagcgtatcttgaaattacacatctcttagccaaaaaatctaaaggaattgcttacatccttcaaaaagagcagttagctagagaagaaacggctgcatttggagatggacataatgatttgcctatgcttgaaatggtaggttaccctattgttatggataatgcttttgatgatatcaaagcgatagcatatcaactaactaagtctaatgatgaagacggagtgggatatgggattcaaaaatttttaaagtaggagccttataatgacaagtattagtgatatagctaaaaaggcaggtgttgctaaatcaacagtttcccgtgttatcaatcatcacccacatgtttctgatgagacgcgacaaaaagtaatggctcttatcaccgaattggattatataccaaatcaactagcgcgggatttaagtcgaggcaaaacacaaaaaataggtgtcgtcattccccacacgcgccatccttattttacacaattaataaatggcctattagatgctgctaaaactaccgactatcaacttgttatgatgccttcggattacaaccaagaattagaactttcctacttgaaacagctcaagatggaagctattgatgctttaatattcacttcaagagcaattagcctcgatattattgaaacttatgcaaaatatggacgaatagtagtttgtgaaaaattgcaggaatataatcatctatcctctgcttaccttgatcgctattcttcatttctagaggcgttttctgatatgaagttacgaggtttggagcacttagttttattattttcaaggaataatgaatcctctgctacctatcaatccgcattattagcttatcaagaggtctatgggcaactatcctctccatatatggtagttgggaatgttcatgactttaatgatggactaaatttatcttatcaattggtaaaagaagttagtatagatggtatattagctacaagtgatgaagttgcggcagggctaataaaaggttatgaagaaagtaggaaaaaatgtccttatattattggtcaggaatgtttattagttgggcaacttttgaaactcccaacaattgaccacaaatcctattatttagggaaattagcttttaaacaggctttagctgaaaagattagtcaagaagttttattctcagagtttttatctcaagacaattagtcattcaaaagtaatagaaaaaaggtttccaactaaacttgattggaaacctttttatttaatgattgataattttaagcatttgtttgaaagcagtctctgcttcaggaatcggtaagactggataaacgtggttcattttttgaccaacgatatagtggtgtttaatgttttcttttgctaatttttgatgtaataattgattatcggggtagaaaatatcgtgcgttcctataaaaaatgatattggagccatcttgttaaattggctactgtaaagaggactaacttgaggatttttaaaattcttttttccatttgcccagtaaggagctacttgttgtaattgccaagctttaagaaggggatcttttttttgaactttttcaatctttggattattagtagcaatatctaaccatggtgatattaaaataatttcttttggttgtttgatatgctccgtgacaaggttatcagcaagacctaaagcaagacctccgcctgcactttcacctactaggataatttgtttgggagatgtgacgctagctaatgtattttggtataattttttaattttggggatagcatcactataattatatgtaggagctttagggtaaataggaaagacaacttttgcatctaattttttagctagtttattgacaaaaatatattgtaattcagaagcttgatggatatatgatcctccatgaacatagaagataaccttttgcttaggattatttttatcattccaagtgaatgtttgcatgccatcagtagcggtaatttctaccttttcattatttaatgcctgaggaatgtctacaggaagaacattacgtttagctaccttagttaagtaattttggtattctttgatggtttgaggcttaatctgatttaccacaggtagagttttttcaatagtattgctagttagggatcttttttcaacaatatgagtgtaagcatatgctcccataaaaatgacaaaaaaggttagaagtagtagtacaataagttttcgatagtttttcatgattatccttttgtaattgagctcgtcatgctaaaaatgattagttgttattctataataaagtagatacgaaaacaagaaaataatgctataaaatttcaacctattataattttttgctgatagtacgtattaacctttaatttgctaaaatagaagagaggagagtgttattatgtttcacagagaagatttttcaaaagcattattaaaaaaagctttgcagcccggtatgagagttatggatattggttgtggtagtggggaattgacgcgtttggctgctgatatcgttggtaaagaaggtgatgttgtaggaattgatattaatgagcaacttttatggcaagctagacatgataatggctatgctaatgttagttatcaaaacgcagatttagcagcactttcctcctttgaaacaaaaagttttgatgcaattattggacgtcgtgtattaatgtatcaaaaagatccaaagaaagtaatagaaagtttaacacctttgttaaagccaaatggtttttatgtttttcaagaaagtgatgcaatgtgtttagaactagctaagcctagctttgtaaatatgaataaaatacaatcactaatctggcaaactgttgagaaggaaggaggacacattcatattggaagtcaacttgagcaattaatgttagaagcaggcttaatcgttgaccattttgtatcagaaaatgtcattcaaacgtcacaaactggtacagatttatcttggctactaaatatcatgaaagaaagaatacaaaaatatagtgaccttcagggattagaagatgtcaatttacaaaaagaattagaagagaataatgaccattttatccgagattgtcaatttggaattatttctcatagagttgatgaatgattttaagtattatttgacaccttgaaaagtttccttatggtataataaggaatatgattgcgattgaagaaattgggagaattaccccagataatttagggttagtaactgttttagcaggagaagatttagggcaatatgctcagatgaaagagaagctatttcaggtaattggattcaataaagacgatttagcctattcttattttgatttaagtgaagaagactatcaaaatgcggaattagacttagaaagtttaccttttttatcagactacaaggttgttatttttgatcagtttcaagatattacaactgataaaaaaacttatttagatgaacaagcaatgaagcgctttgaagcctacttgcagaatcctgtagatactacgagacttgttatttgtgctccaggaaaacttgatggaaaacgtcgacttgtaaagttattgaaacgtgatgctcgtgttttagaggctaatactttaaaagaatcagatttaaagacgtattttcaaaaatatgctcaccaagaaggattagtttttgaagcaggtgtttttgatgagttattgattaagtctaactatgattttagtgatactttaacgaatatcgctttcttaaagtcatataaaacagacggtcatatttcgtccaatgatgttagagaggctatccctaaaagcctgcaagataatatatttgatttgactcaagatgtcttacttggcaggatagatttagcgcgtgatttagtaagagatttacgtctacaaggcgaagacgaaatcaaattgattgcaatcatgttaggacagtttcggatgtttttgcaagttaaaatattggctagtaaagggaagtcagagagtcaaattgtttctgaactatcccattacataggacgtaaaatcaacccttatcaagtaaaatttgctgtcagagattctagaaaccttccccttgcttttttaaaagaagcgattaggattttaatcgagactgactatgctattaaaagagggacttatgataaggattatctctttgatttagccttattaaaaattgctcataaaaagccctaattaaagaaacaaaagagttgaaagctgttccaaattcctatagaataagggtaataatagatgaaaagaggatttcgacatggcaattattttaccagatttaccctatgcatatgatgcgcttgagccacatattgatgctgagacaatgacactacatcatgataagcaccatgcaacttatgttgctaatgcaaatgctgctcttgagaaacatcctgaaattggagaagacttagaggcgctcttagctgatgtttctcaaattccagaagatattcgtcaggcagtcatcaataacggtggtggacatcttaaccacgctcttttctgggaattgatgtcaccagaagaaactcaaatttcacaagagttatctgaagacattaatgcaacttttggttcatttgaagactttaaagctgctttcacagcagcagcaacaggacgttttggttcaggttgggcttggcttgttgttaatgctgaaggcaaacttgaagtgctttcaactgccaatcaagatactccaattatggaaggcaagaaacctattttagggcttgatgtatgggagcatgcttattacttaaactatcgtaatgttcgtcctaactacatcaaagctttctttgaaattattaactggaataaagtaaatgaactttaccaagctgctaaagcttaataaaaaacgagtcgataggctcgtttttttattattctaaaagttgataatgttttttaaaagtctagaagtccaaactcagataaaactagaatagtcctattatcttcaactaagcgaataagtttattgaaagcgcttgacaagattagtaagaaatgataaaattaagacgttttcaggtgttattatttaaggtaagcaagctgataacagataaaattgcataataaaggatgttatcacattttgtgagcagggacctattcaacgacgactttttgttgtgtcttggatgggtcattttttattgtgcgagtgaaggactaggactttaatgattataaaacgcgtattaaatcataatgcagtcatatcagtaacacatcaaggattagatgtgctactgatggggaaaggaattgcatttaagaaaagaataggtgataggattaatagcgatgctattgagaagtcatttgttttaaaaaatagtgataacatgaaccgttttacggagttatttattactgttccagaagaagtagttgcatgttcagaacgaattatcaacctaggtaaaatcaaattgggtaagaacttagatgaaattctttatatcaatttgacagatcatattcattcggctattgaaagacatgaacaaggaatggttatccaaaatccactaaggttggaaatccaacgttactatcctgatgaatactccattgggatgaaggctctggaacttataaaggatgaattgggcatttgtttaacaatcgatgagtcggcttttattgctatgcactttgtaaatgctggattggataatccgtttaatgaagcgcataaaatcactgagattgtatcttacattgaacagaaagtaaaaatagattttcgaacagaactagatgaaagttcaattgattattatcgtttcatgacacataccaaattatttgctcaacgcgttttatcaggaatgaaatacgaagatgatgatgctgatttacttttggtagttaagaaaaaatatccgagagaatataaatgtgttaaagagatcggcaacaatatggctatccaataccaatatcaacttaattcaagtgaactcctatatctgacggtgcatgttaaacgattagttaaaaatttaaaggagatatcagatgactaaataccaagagactgctaaagctattttagcagcagtagggggagaaaaaaatattcaacacgtaacccactgtgtgacacgattacgattagttttagacaatgatgaaattgtcaacgatcaggttattaaaactattccgaatgttatcggtgttatgcgtaaaaatgatcaataccaaattattttgggaaatgatgtcaataattattataatgcttttttggccttaggtcattttgaaaatactaccagagaattttcatcacaaaaaaagagttcaatacttgagaaattaattgaaacgattgcaggagtcattacgccgcttatacctgctcttctaggaggagggatgctcaaggttataggtattttgctccctatgctcggtatagcaagctctagttctcaaacagtagcttttatcaatttttttggtgatgccgcttattattttatgccaataatgattgcttattcagctgcgtcacgatttaaagttacacctgtattagctgctacagtaggagggattctcttacaccctgcttttgtgacaatggtagctgaaggaaaaccattatctttatttggagctccggttacactggctagttatggttcttctgttattccaatcttaattatggtttttcttatgcaatatattgagagatggattaataaaattgttcctagtgtaatgaagagttttttacaaccgactttgattattctcatttctggctttttagctttagtggtcgtggggccactgggggtaattattggtaaaggattgtctagtgcaatgctttcgatttaccatgtggcgccatggttagctttatctattcttggtgctattatgccattggttgttatgacaggaatgcactgggcatttgctccaatatttttagctgcttctgttgcgacaccagatgttttgattttaccagcaatgttagcttctaatttagctcaaggtgcggcttctcttgctgttgcagttaaggctaaacaaaaacaaacacgtcaggtggcctttgcagcaggtttatcagcactactagctggtatcacagaacctgcactttatggtgtcacactgaaattcaagaagcctttatacgctgcaatgatatcaggtggtttagtaggagcttatattggattagttaatattgcttcctatacatttgtagtaccatctattattggtttgccacaatatatcaatccacaggggggcaataatttcagtaatgctgttattgcagcaatagctactattattttgactttcattattacatggttcttgggaattgatgaaggagaaaacgaaaaaagtagtattaatgctcaagagcacacacatattagaagtggtttatcaaaaaaagagacattgtattcacctatggtaggcaatgtattacctttatctaaagtacccgatgaaacattttcatctaaattactaggtgaaggtttagcaatcactcctagtgtgggtgaagtttatgcaccatttgatggtgaaattataagtttatttcctacaaaacatgccattgccttaaaggatgataagggagtcgaagtgttaatccatattggaatagatactgtagaactaaatggagaaggttttgaacaattggtcaaagttggcgattttgttaaacgaggacagttacttttgcgaatggatattgattttattagttcaaaggggtattctcttattagtccggttgtagttacaaattcaattgaccaacttgaaattatcgttaaagacgcagagacaatggttacaaatgaagatgatttacttgtaattctttaaaaggaaggatgataatatgacggtttttcctaaacattttctatggggaggtgcagttgctgccaatcaggtagagggtgcatttagaacagatggcaaaggtttatctgtacaagatgtacttccaaatggtggtttaggcgatttcaccgccaaacctactccagacaatttgaagctagaagcaattgatttttatcataactataaaaatgatataaaactgtttgcagagatgggctttaaagtttttagaacctctattgcctggtctcgaatttttccaaatggtgatgatagtgctccaaacgaagctggcttacaattttatgataatttatttgatgagttgcttaaatataatatcgagcccttggttaccttatctcattatgaaacaccgcttcatcttgcaaaaacttataatggttgggctgatagacgtttgatagcattttttgagaaatttgctcaaacagtcatggagcgttataaagataaggtgaaatattggttgacttttaatgaagtgaattctattttacatatgcctttcaccagtggtgctattatgaccgacaaatcacaactaagtcctcaggagctttatcaagctattcatcatgaattagtagcatcggctagagtgacaaaattagggcgttctatcaatcctaattttaaaattggctgtatgattctggctatgccagcttatcctatgacatctgatccaagagatgtcctggctgcaagacaatttgaacaacataatctgctattttcagatatacatgtcagaggtaaatatcccacttatattcagtcctatttcaaaaataatggtattaaaattaaatttgaagaaggagatgaggaagtattggcacaaaatacagtagattttctatcgtttagttactatatgagcgtgacacaagcttatgactttgaaaattatcaaagtggtcagggaaatatccttggaggcctaactaatcctcatttaacaacttcagaatggggatggcaaatcgatcccatcgggctacgcctagtcttaaatcagtattatgaacgttatcagattccgttgtttattgtagaaaatggattgggagcaaaagatcaattgatagaaacactagacggtgattatactgtcgaagatgattatcgtattgattatatgaatcaacatttagttcaagttgctaaagctattgaagatggtgttgaaataatgggatatacatcttgggggtgtattgattgtgtatccatgtctacagctcaactaagtaaacgttatggtctaatatatgttgatcgaaatgatgatggaacagggagtctacaacgttacaagaagaagtcatttggttggtaccaaaaagtgattaagacaaatggccaatcattgtttgaacatcataacagataacatgttaaacaactagtctctgtttcaatttaatataaaaaggagtatccataggttactcctttttattataatttatgaaggttaatatcttctgatttaagtgctagatacaataaagttgcatccttaaagtttcttggattgagttgcgttgattcataaatcttatttaacctatattgaacagtatttttatggataaaaagttcctgactacattcttttaatgatagattatgcttaaaatatgagttaagcaagatcttatcattttcagataagtttacaagcgctttatttagcacatattgtttaatattagaatcaatacttgttaataacagttcaagatcaaggtcgtcgacgaggttgaccttttgttgaccttttaaagctttcagggctaagatagacgtttcatatgatctttttaaaagtgataaagatgatttttgtccgataccaactttatagaggcccttttcgcattcaaactttgataggatatttggataataatagtcaaacatatggtcagaaagtaaaagccagtattgattgggataattaaaggtataaatagcagtgtcaagtttatcaaaaaagttcaagagtgacatttcagattgacttaagagtaatttttgtttttgactattgatttcaaaagtgagtagacgatagtcagttttttctgataggtggtattggtttaaaaattgattgaggtaatagtagtctaactctctgccttcaacaagatgatgtaagacaatagaagcttcgttttttcgcccgaaatccagataatctaattcatgctcttttaagatgagtcgagtcattttttgagcaagtaaagcatattttcctacttggttggggtttccactaatcccaatagtagctaataattcacaattataatagaaaggaatattgatccctgcttgtgtcccaaaataagattcttgatctgttacttcaatcatttgtcctgtctgtgctacttttaaaccaatttcatggaattctccaacacgttttggattggtactagcgaaaatgattcctttggtattaataaaattaatatcttgttgacaaacatctttgatagaggtaacgatttgttgtgcgagttgttttcttaatttcattcagcttaccttttgttatatataacaaatatcatatcataaaaacgctaacatttgttctgtagtctatattttttgttatttgattttgttactataattgagtgatataaaatagtgaaaaaaataacaaagattcacaaaatattttcaaggaggttttcaaatgaaggtagtagtagctattgattctttgaaagggagtctttcttctttagaagctggcaatgctataaaggagtcaattaatgaagtaatctcaggggcggatgtggaagtacatccattagcagacgggggagaaggaactgttgaagctttgacgctaggtatggggggtacgatcgaaacaatccctgttaaggggcctcttggagaaaaagtacatgcgagttatggtattattccacagcgtcagttagctattattgaaatggctgcagctgctggtattaccctaattgctactgaagagagaaatcctctccacacaaccacttatggagttggagaaatgataaaggatgctataagtaaaggctgtaggcactttattattggtattggaggtagtgctactaatgatggtggggcaggtatgctacaagctttgggatatgcattattagataaagataatcaagaaatcagtttgggagcacaaggattggcagatttaaaatctatctctactgataaggttattgaggaattaaaagaatgtgattttaaaattgcatgtgatgtaacaaatcctttatgtggtgctcaaggttgtagttcgatttttggaccgcaaaaaggtgctgatgaagatatgattacaaaaatggatacttggttaagtaattatgctaccttagctacttcagttagtgaaaaagcagatgcaactattgaaggaacaggtgcagcgggtgggcttggatttgcctttttagcctttacaaatgctaccttagaacctggtattgatattattctatcagaaattaatatagaaaaagcgatttctgaagctgatttagtagttactggtgaaggtcgtttggatgggcaaacggtgatgggaaaagctccaattggcgtagcaaaattagctaaaaaatatggtaagaaagtagtggcattttctggatctgtcaccgaagatgctatactttgtaatcaacatggtattgatgctttttttccaatcgtacgacgccttatcagcttagatgaggctatgtctaaagaggtagcttataaaaatatgaaagaaactgctactcaagtctttagattaatcaatttgtataatcattaatattgaaaggaattttgataagttatggaagctacatttacaacaacaggggctttaataggattagcgcttgctattttactgattatcaaaaaagttcatcctgcctatagtctcattcttggagcattagttggtggtttgattggtggcggtgatttagttacaattgtcaatacaatggtattaggtgcgcaagggatgatgtcatccatattacgcattttaacatcagggattttagcgggtgctttaattaaaaccggatcagctgaaaaaattgcagaaagtatcattaaaaaattaggacaacagcgagccatcacagctttagccatcgcaacaatgattatttgtgcagtaggtgtctttattgatattgcagttattacagttgctccgattgcattagcaataggtaaaaaagctaatctttctaaatctagcatactgttagcaatgattggtggtggtaaggctgggaatattatctcacccaatcctaatacaattgctgcttcagaagcatttaaggttgatttaacaagcttaatggtacaaaatattattcctgcaattgcagctttagtagttacgattatattagcaaagattgtttccaagaaaaataacgatatttcttatgatagtgaggagcaagtgggctctgatctgccagcattcttaccggctatttctggtccacttgtggttatctgcttattagctcttcgtcctttatttggaatcactattgatcccttgattgcactgccgttgggtggtctaattagtattttagcaacaggttacctaaaagaaacggtaccgtttgttgaatacggtttatcaaaagttgttggcgtttcaattcttttgattggaacaggtacgctctcaggtattattaaagcatctaatctacaatttgatatgattcatctccttgaatttttaaatatgccgacctttatccttgccccactctcaggtatttttatgggagcagcaacagcatcaacgacttctggaacaactattgcttcacaaacgtttgctgaaaccttgattaaatcaggggtaccggcggtttcgggtgcagctatgattcacgcaggtgcgactgttttggattcgctacctcatggatccttcttccatgcgacaggcggagctgtcaatatggctataaaagatcgtatgaaactaattagctatgaagctttgattggattaactagcacaatagttgctgtcgtttactattgtttctttgggtaaaatttggatgaatacgtgatgtttattatcactgtttgaatagaattctcattgattttttctaattttcttactataataaattagtaggagaggtgttgtgaaacaaacaaagaaagaatttattttaggattaaccattattattacccttactttattaatcatgctgatttttttagtaatgtttaataagtccagtaactctaagttgaagcagacaaaagatagaagaatatcatctacttcaaccacaaggacatccagtagctcacatgatcaaaaaattgtagaaaagtctcttgaaaaaaagaaaatggtcatggaacaagatatggaattgatgaatgcctataggctctattatgattatgcccatttgtccttgaaagaggttgttctggcctatatgtctgaatatggcattgaaaaaaatagtgttgctttttcttataaaaatttaaaaacaggacaaagggacgctatgaatgatactcaggctatgacagcagggagcacctataagttacctcttaacatgttggtagtagatgcagtggtcaagggcaagttgtccatggaagaacgctttgatattaccgagactgactatgaatatattggtgaacataataattatgttgctgctttctcgggggcaatgtctattgatgatatgcaaaaatactctttagtttattcagaaaatacacccgcctatgctttagctgagcgtattggtggcatggatagtgcttattcaaagtttggtcgttatggccaatctaaaggagacatcaaaaatatacaaaaaaacggtaataaagtgacaacagattactatattcaagtgctagactatctctggaaacatcgtaaaaagtatgatagtttaattacttatttagaagaagcttttccaacagattattatcgtgctttgataccatctgatgttgttgttgctcaaaagccagggtatgtccgtgaggcgttgaatgttggagcaattgtcaaagaagaagtgccttatattgttgctatttatactgcaggtttaggtggctctactcaggaagattcagaaattaatggagtgggactatatcagctagaacaattatgttttgttattaatcaatggcatcgtgttaatatgaattagaaataaatctatcaaaataataaaaacctcttagattaactatctaagaggtttttataaatgtgattttataacttggttaagtgaagaaagggcagaaacagttttttgataagattcaggactaatttctgagaaaaaatacccgcacgattgcaccgcattgacaacggcatcttgtgactcaatacctttgttacttagatgaataatgagttgccttttatcatctcttggtttttctcgtacaatccacccacgattttccatacgctttaaaactggagttagggtattcgaattaagagatagtgcataactaagttccttcatatgccgatgatcctcttcccaaaggactaacaagataacgtattggagataagtcaattgaaattcatccaaagctttttggtaaaatttattgaaaagtcgatgtgtttcactaaccgtaaaacataatcgctcgtctaaaatacttcgattactcattatcatattgtagcattttggaggcgttatagtatgtcaatcgtgttaaaaaatgataaaactttttcctaattgaaagcctattcttacttaacaaacatagcatcaccaaagctgaagaaacgatatcgttcttcaactgcatggttgtaagcttctagtacaaaatcacgtccagcaaatgctgatactaacatgacaagagtagactttggtaagtgaaagttggttgaaaaagcgtctacaaccttgaactgataaccaggcttgataaaaatatttgtccaccctgagtcggcttttaattcaccattgaatttagaaccgattgtctctaatgtgcgaatagaagttgtaccaacagctacaatacgtccaccagattctttaactgcattgagagtatcagcagcttctttagataattggtaaaactcagaatgcatttcgtgttcatcaagattatcaactgaaacaggacggaaagttccaagtccaacgtgaagcgtcaaatagacaagcttcacaccttttgtttcaattttttccaatagttcttttgtaaaatggagaccggctgttggtgcagcagcagaaccattttcttttgcatacacagtctgatagcggtcacgatcttctagtttttcatgaatatatggcggaagtggcatttcgcccaaactttcaaggacttctagaaaaataccatcatatgagaattctacaatacgcccaccatgttctaattcctttgtgactgttgctattaaccgaccatcaccaaatgaaactttggtccctactcgtaagcgtttagcgggtttagcaagcacttcccattgatcgccttctgtatttttgagaagtaataactctacatggccgtgtgtatcttgcttttcaccataaaggcgagcgggcagaacacgtgtgttattcattactaaagcatcaccaggcttgagttcatctaagatatgatcgaaatggctatctgtcatcgtcttattcttatgatcaatgactaataatttagaagcgtctcttttttcaagtggtgtttgggcaatgagttcttctggtaaataaaaatcaaaatcgtttgtattcatgatttctcctatctataagtaagcttttctattatatcacgttcagtaaaaatgacccaactaatctttttatttagaatgattataaaaaataattgtaatcattctaaataagtgatataataattgtcagaaagtgagaagtagagaagatgaaagaagcaaaaaatttttcccaacaattgaatattttaagagctggtgttcttggtgctaatgatggtatcatctctgtagctggtgttgttattggtgttgcgagtgcaactcataacctttggattatttttttatcagcagcttccgcgattttagctggtgcattttctatggctggcggggagtatgttagtgtttctactcaaaaagatactgaacaagcagcagttgcgcgtgaagagaaactactagaaaataatccagaacttgccaaaaaatccttagttgatatctacttagcaaaaggagaaagtcacgaacatgctcaatggctagttgacaaggctttttcaaagaatgctattgagcatttagttgaagaaaaatatggtattgagttcggtgaatatacaagcccctggcatgctgctatatctagttttatagcttttgccatcggatcaatttttccaactataactattctgttattgccattttcggtacgaattgtaggaacggtaataattgttattgtttcactattatcaactggttatgtaagtgctaagttaggtcaagctcctacagtacctgccatgcgtcgaaatgtgatgattggttgtttgacaatgttggcaacctacgtcattggacaattattttcaatataaaatattaatcgtggagttattgtctaaactagaatggacagtaattctttttagttttataacgaaattaagaagtttttattgacaaaaattggtatataccatataatataatcataaaggtctataccaaataaaaggagagtaaacatgagagttattacagttaagaacgacattgaggggggaaaaattgcatttactcttttagaagagaaaatgaaagctggtgctcaaactttaggattggcaacaggaagtagcccaatcaccttttacgaagagattgtaaaaagtaatcttgatttttcaaatatggtttctattaaccttgatgaatatgttggaattgccgcaagtaatgatcaaagttactcttattttatgcataaacatctttttgatgctaaacctttcaaggaaaataaccttccaaacggcttggctaaagatttgaaagaagaaataaaacgatacgatgctgtcataaatgctaatccaattgattttcaaatccttggaattggtcgtaacggtcatattggttttaatgaaccaggtacaccttttgatattacaacacatgtggttgatttagctccaagtacaattgaagctaatagtcgtttctttaatagtattgatgatgtaccaaagcaagccttatcaatgggtataggctctattatgaaatcaaaaacaatcgtattagtggcgtatggtattgaaaaagcagaagcgattgcaagtatgattaaaggacctatcacagaagatatgccagcaagtatcctccaaaaacatgatgatgttgtgattattgtggatgaagcagcggcatcaaagttgtaaagtaaataataaaaaagtaaggatgaatctcaatgagaaaaaattcattcttacttttttattatgctttattaaattgtccagtctaagttaggtccagctggaataataccagtagggttaatggttttatggctaccgtaatagtgttttttgatatgatcaaaattaactgtctcagcaattccaggtaggttgtaaatacgttttgtataatgccataaatgtgggtaatcatgtagcgcttttaaattacatttaaaatgaccataataaacggtgtcaaagcgaactaaagttgtgaaaaggcgaatatcagcttcggtaaattgttctccaacaagataatggttatcagataagtgtttttctaactgatctaaagctgtgaataaggtttcaacttccttttgataaacgttctgagaagtggcaaaaccagctttatagacaccattatttatttttggataaataaaattattcatttcgtcaatttgtccttgtaaggaatcgggatagtaatcgtcagtatttccagtaatatgattaaatgcagtatttaacatacgcataatttcagatgattcattgttaacgattgtatggaattttttatcccaaagaacagggactgtcacgcgtcctgtataatcactttgacttgcttgatagatttggtaaaggtattggctttggttaatcatatcaggaataacgcctttatattcttgaaaagtccaaccattctccaacattaaagggttaacaatggagatagagatatgagattctagatttttaagctttctcatgattaatacacgtgatgcccaagggcaagctagtgaaacgtagagatgatatcgtccagattctgctttaaaacctgcatccccactaggccctgctgaaccatctttagtaacccaatgacggaattgtgtaacggttcggacgaatttaccaccagttgatgcagtatcataccattgatcaacccatttgccatctactaaaagtcccatgataatctcctttgtttttctattactaattagtagtataaagattttaaaaagaattagcaaatgtttaacttacagtatggtaaactaagggtatgcgtttagataaattattaggtcaggcaggatttgggtctagaaatcaggttaagaaattaatttgttctaggcaagtttctgtagatggtcaaattgttacaaaggataatgttattgtagatagtggtctacaatcgatttttgtaggaaaagagagggtctgcctaaaagaaagttcttattaccttctttataagccatcaggagttgtttcagcagttagagattcagaacataaaacagtcatagacttaattagcgaaaaagataaggtggagggattgtatccgattggtcgtctagatcgtgatacggaagggcttttaatagtcacgaataatggtccactgggttaccgaatgttacatccaaaacaccacgttgcaaaaacatattatgttgaagtaaatggtttcttggaaagagatgctattaccttttttgaagaaggagttgtatttgacgatggaacaaagtgtaaaccagctgaattaacgattgatacggctaataatgacaaaagtaccgcaagaataactatcacagaagggaaatttcaccaagtaaaaaagatgtttcttgcatatggcgttaaagttatatacttgaggcgtatttcttttggtgacttgaggcttgatatgaatttgaaaccaggtcagtatcgtagattgagagattcagaggcagctatcttaaaaaggtatttagattagtgaaacgactcacttgaccttgcttagtattcttcatatacttataagtgattattttaaaggagaaaaccattgaattcaaaactttcattgaaattgactattttatcgatttctatctttttgatgtctcatttagcaattgctcctgcaattcctaaattgtatgccttttaccatactcaaaaccctcatattggactagcttcagtagagagtttagttactattccagctatgatgattactatttttgttattttgagtaattttgtagtcacaaaacttggcaaaaaaaacacggtcttacttggtttatgtttaatcttaatgtctgggtttatctcattttttacaagtaatttttcacttgcgatggctagtcgactacttttgggtattggtattggtctctataattcgctatcaattagtatcataacggatttatatgaggctgatgagagagccagtatgattggtcttagaacagcatcactcaatatcggtaaagccttaactacatttattgttggattggttttagctattggtgtgaattatatttatttggtttaccttctggttattcctgttttctttttcttttggaaaaatgttccagaggttgaaaatcaaacacatacccttaaagctagtacaacatttgatactaaagcggctttgttgatgctcatcacgttcttagtaggtattgcttatataggagcaactgtcaaaattccaaccttactagtgacaaaatatcactacgcgacgagcttctctagtaatatgttaactctccttgcttttagtggtattttagttggatctgtatttggaaaattagttaaagtattccaagagaagacgctattaatcatgattctagctatgggaataggtaatgtgctatttgctttagctaataatcagatcatttttatcgtagctagtattttaataggagctagttttgttggcaccatgtcttctgtattcttttatatttcaaaaaactatgcaaaagaacataataactttatcacaagccttgccttaacagctggtaatataggagttattttgacaccgcttattttaacgaaacttccaagccagctacatctggaaccttttatgacaccatttttaataacaagtgggctgatggtgattaatgtctttgtttacctagttttaatgtcaaaaaataaataaaaagttatccgaaaggataacttttttcgaatagtaaaagtaggagaaaaaatgttaattgctaaagacaaacaaggaaatttaattaatctactcgagtctcatccgggaaagggacagtatttttgtccaacttgttgttcagctgtaaggttaaaggcaggtcgaatcatgagaagacactttgcacatattagtctaaaaaattgtcagttttatcatgaaaatgagtctaatgagcacttgcaattaaaagcaaagttatatatgagtttaagtagagagaatgaaactatgctcgagcatcatttgccagaaattaatcagattgcagatttatttgtgaatgagacattggctttagaagttcagtgtagccgactatcagagcagcgactcagggagcgaacaaaagcatatctacaggcagactttcaagtgagatggttactaggggaaaaactctggttaaagcatcgtttaacaaatctacataaacaatttttacaattttctcaaagtatcggatttcatatttgggagttagatttgaggttagaagtactgagactaaaatatttgatttacgaagatttacgcggacatgtctattacttaagtaaaacttgccctcttagtggagacgttctagcatttttgaagtggccataccaatcaaaaaatctaaatttttataaggttaaacaagacagaaatatcagagattatgtgcgtcagcagttacgctatggcaatcaattttggttacgaaaacaagaaaaggcctacctttctggtcagaatctattgacccaagagctaatgatgttttttcctcaaatacagccaccacgtgtagatactgatttttgtcaaataacaaattctctaacatcgttttatcagaattttacaaattattatcaaaaaaataagaataacttagaccaaacactttatccccctgtattttatgataaaatagtcactaagaattaaactggaggatacaaaatgtcagacaatcgctcacatattgaagaaaaataccaatgggatttaactactgtctttgcgactgatgagttatgggaaactgaagtggtagagcttactcaagccatcgataatgcaaagggtttttcaggtcatctgttggactcaagccaatctttattggagatcacggaggttgaattagatttatctcgccgtttagaaaaagtttatgtctatgcttcaatgaaaaatgaccaagacaccactgttgcgaaatatcaagaatttcaagcgaaagcgacagcgctctatgcaaaatttagtgaaacattttcgttttacgagccagaactattgcaactttcagagtctgattaccagtcattccttttagaaatgcctgacttgcaaaaatatgatcatttctttgagaaaatatttgcaaataaacctcatgtcttatctcaaaacgaagaagaattgttagctggtgctagtgagatttttggagcagctggtgagacatttgaaatccttgataatgcagatatggtcttcccagttgtaaaaaatgcaaaaggtgaggaagttgagcttacacatggtaatttcatttcccttatggaatctagcgataggacggttcgaaaagaagcatatcaagctatgtatagcacatatgaacaattccagcatacttacgctaaaacattacaaacaaatgtgaaatctcaaaattttaaggctcgtgtgcatcattatcaatcagcacgccaatcagctctatctgccaattttattccagaagaggtctacgaaactctaattaagacagttaatcatcatttaccgctcttacatcgttatatgaagttgcgtcaaaaagttcttgggctagatgatttgaagatgtatgacgtatatacacccctttctcaaatggatatgagttttacttatgatgaagctctaaaaaaatcagaggaggttctagctatttttggcgaagcatattctgaacgtgttcatcgtgcttttactgaacgttggattgatgtccatgttaacaaaggaaagaggtcaggcgcttattcaggtggatcttatgacactaatgctttcatgcttcttaactggcaagatactttagataatctttatacgctggtgcatgaaactggacatagtctacactcgacgtttactcgtgaaaatcaaccctatgtttatggtgattattctattttcctagctgaaattgcatcaacaacaaatgaaaatatattaacagaaacccttttgaaagaagttaaagatgataaaaatcgctttgcaattctcaatcattatttggacggtttcaaaggaacaatttttaggcaaacacagttcgctgaattcgaacatgccattcatgtagctgatcaggaggggcaagtactaactagcgaatacttaaacaatctttacgctgagcttaatgaaaaatattatggtttgactaaagaagataatcattttattcaatatgaatgggcaagaattccacacttttactacaattattatgttttccaatatgcaaccggcttcgcagcagcaaattatttagcagagcgtattgtaaacggtaatccggaggataaagaggcctacctaaattaccttaaagctgggaattcagattaccctctaaacgtcattgctaaagctggtgttgatatgactagtgcagactatctggatgcagcttttagagtatttgaagagcgtttagtggaactggaaaatcttgtagcaaaaggcgtccataatgattaagttgaaaatatagctattgaagtaaaaccagtcaactagactggtttttgatagtgatcagttattttatagtttgttttgagagtggttttggtaaagttagttagtggaaaactcaataggtggaaatacctacccaagttatgatttttatgagaccaaaactgctattgtcaaaaaagaagggaaataggatgaagaagcttacttttatttgggatttagatgggacattaatagattcgtatgtaccaattatggaagctcttgaagaaacctatcgtcattttggtttaatatttgataaagaattaatccatgaatatattttacaggaatcagtggggaaattattggtaaacctttcagaggaagagcaaatacctcatgaaaaactgaaagcatattttacaaaagaacaagaaagtcgagattctaaaatacatttaatgccatatgcaaaagagattttagaatggaccaaagaacaagatatccccaattttatgtatacacataaaggagcaagtacgcattcagtgttggaaaccttgcagatctctcattattttgatgaaattttaactggtgtttcgggattcgagcgaaaaccacatccacaagggattaattatttagttaaacgatattctttagataaatcaatgacttattacataggagatcgtccactagatttggaggttgctcaaaatgctggtataaaatccataaacttaaggttagagaattccaaagaaaactataatatttcaagtctcaaagatataatatcacttgatttcactcgtttggattaaatcattctcagagttagacattttttgctataataaaaaagttattatttaaaatagaaaagaggagccaaaagtggttcaatcttacagtaaaaatgctaatcataatatgcgtcgtccagtagttaaagaagaaattgttcaatatatgcgtcagcaccaaaaacaaaataatggctgtttagcagagttagaagcatttgctaaacaggaaaatatccctattatacctcatgaaacagcgacttattttcgttttttgatgcaaacattacaacctaagcacattttagaaattggaacagctattggtttttcggcccttttgatggcagaaaacgctcctgaagcaaagataacaacgatcgatcgtaatgaagagatgattgccttggctaaggaaaactttgcaaaatatgataatcacaatcagataacccttttggaaggcgatgctgtggatgtgttacaaacattggataaatcttacgattttgtattcatggattctgctaagtctaaatatatcgtttttttacctcaagtattaaaacatttagatgttggaggagtagttgttttagatgatattttccaaggtggagatattgcaaaacctatcgatgaagtgagaagaggtcagcgaactatctaccgaggtctgcaacgtttatttgactcgactttgcaacatcctgatttaactgctactttggtacctttgggagatggtttattgatgattcgtaaaaatgcagatcatattgtactagaagattaaggcatttttaagaaattatgatataataatggagttaatgacaaaaaggagttataaatcatgaaaacaagatcaaaacttgcagcaggctttttgacacttatgtcagttgccacattagctgcctgctcaggtaaaacatcaaatggaacaaatgttgttacaatgaagggcgacactattacagtctctgatttttatgatcaagtaaaaacatcaaaagctgcacaacaatcaatgcttacattgatcctctcacgtgtttttgatacacagtatggtgataaagtttcagataaaaaagtatcagaagcttataataagacagctaaaggctatggtaattcattttcaagcgcactttcacaagcaggtttgactccggaaggttacaaacaacaaattcgcacaactatgcttgtggaatatgctgtaaaagaagcagctaagaaagaattaacagaagcaaactataaagaagcatataaaaactatactcctgaaacttctgtacaagtaatcaaattggatgcagaagataaagctaaatctgtccttaaagatgtaaaggctgatggagctgattttgcaaagattgcaaaagaaaaaacaacagctactgataagaaagttgagtataaatttgattctgcagggacaaccctccctaaagaagttatgtcagcagcctttaagctagataaaaatggtgtttcagatgtggtttcaacggttgattcaacaacttataaaacaagttactacatcattaaagtaactgataagacagagaaaaaatctgattggaaatcttacaaaaatcgcttaaaagaagttattcttaaggataaaacaagcgatagagccttccaaaataaagtgatttcaaaagccttagaaaaagctaatgttaagattaaagataaagcatttgcaggcatcttatcacaatatgctacaacaagtggttcatcatcacttaaaaaatagttgaccaagtcttaaaaagactgtataattaatactattgagaatgaaatttcaacgattagatacagaaaagtgacggttgctgcgagtcatggataatcagaaaaagatgctactcaatggggtaaaactaaaaataaatgagaatgacaagttcattgaatgaaggtggtaccgcggttttcgcccttcgtaatggacttgtcttttgctatttgtcaactttcgaggaggaagagatatggctacttttcaaattaaagaaaaaatgttttctctaggcggtaaatttactattacagacctgactgggcttccctgttatcacgttgaaggaagtttgttccctctacctaagacttttaaagtctttgacgaagaggaacatctcattagtcagattgagaagaaggttttaagttttttaccaaagtttaatgtgacattagccaatgggaatcatttcacgattaagaaagatttctcatttttgaaacctcattacaccattgaagaccttgatatggaagttaagggaaatttttgggatatggatttccaactcttaaaagacaatcaagttatagcaaacatatctcaacagtggtttcgtatgacttcaacttatcaggtagaagtttacagtgaaacttacaacgatttgacaatttcgcttgtcatagcgatcgactatgtcaaagagttagaaaaaaatgcatcaaactaattttaggagagaataatgaaagaattatcgtctgcacaaatccgccaaatgtggttggatttctggaaatccaaaggacattccgttgagccttcagctaacttggttcctgttaatgacccaacgcttctttggatcaactcaggtgttgcaaccttgaaaaaatattttgatggttcagtgattccagaaaatccacgtattaccaatgcacaaaaatcaattcgtactaatgatattgaaaatgttggtaaaacagcacgtcaccatactatgtttgaaatgcttggtaacttctcaattggagactatttccgtgatgaagctattgagtggggatttgaactcttgacaagtcctgaatggtttgacttccctaaagacaagctctacatgacttattacccagatgacaaggattcatataaccgttggattgcttgtggcgttgaaccaagtcacttggtgccaatcgaggataacttctgggaaatcggtgctggtccttcaggtccagatactgagattttcttcgaccgtggtgaagattttgatccagaaaatattggacttcgtcttttggctgaagatatcgaaaacgatcgttacatcgaaatctggaacattgttctctcacaattcaatgctgacccagccgtaccacgttcagaatacaaagaattgccaaacaaaaacattgatacgggtgcgggtcttgaacgtcttgcagctgttatgcaaggggcaaaaacaaactttgaaactgaccttttcatgcctatcatccgtgaagtagagaaattgtcaggtaaaacttacgatccagatggcgacaacatgagcttcaaggttatcgctgatcacatccgtgcgctttcatttgccatcggtgatggtgcgcttcctggaaatgaaggtcgtggttatgttcttcgtcgtcttctccgtcgtgcggttatgcacggtcgccgtcttggcatcaacgaaactttcctttacaaattggttccgactgttggacaaatcatggaaagctactatccagaagtgcttgaaaaacgtgattttattgagaaaatcgttaaacgtgaggaagaaacatttgctcgtactatcgatgctggtagcggtcacttagattcattgcttgcgcagcttaaggctgaaggtaaagacacacttgaaggtaaagatatcttcaaactttatgatacttatggattcccagttgaattgacagaggaattggcagaagatgcaggctataagattgaccacgaaggctttaagtcagccatgaaagaacaacaagaccgtgcgcgtgcagctgttgttaagggtggttcgatggggatgcaaaatgaaaccctagctggtattgttgaagaatcacgattcgaatacgacacatatagtcttgaatcaagtctttcagtcatcatcgctgacaatgaacgtactgaagcagtttcagaaggtcaagctcttcttgtctttgctcaaacaccattctatgctgaaatgggtggacaggttgctgaccacggtgtcatcaaaaatgataagggtgacacagttgctgaggttgttgatgttcaaaaagcaccaaatggtcaacctctacacactgtaaacgttttggcatcactttcagttggaacaaactacacacttgaaatcaacaaagagcgtcgtttggctgttgagaaaaaccacacagcaactcacttgctccatgcagctcttcacaatgttatcggtgaacacgcaactcaggctggttcattgaacgaagaagaattcttgcgctttgattttactcactttgaagcagtaagcaatgaggaacttcgtcacattgaacaagaagttaatgagcaaatttggaacgatcttacgatcacaacgactgaaactgacgttgaaaccgcaaaagagatgggagcaatggcactttttggtgagaaatatggtaaagtggttcgtgtggttcaaattggtaattattctgttgaactttgcggtggaactcacttaaataattcttcagaaatcggtctcttcaagattgtcaaagaagaaggtattggttcaggtactcgtcgtattattgcagttactggtagacaagcttttgaagcttatcgtaaccaagaggatgcactaaaagagatcgctgctactgtaaaagctccgcaattgaaagatgcagcagctaaagtacaagctcttagcgactcacttcgtgatcttcaaaaagaaaatgtagagcttaaagaaaaagcagcagctgcagcagctggtgatgtctttaaagatattcaagaagctaagggcgtgcgcttcattgctagtcaagttgatgttgcagacgcaggtgcacttcgtacatttgctgataactggaaacaaaaagactactctgatgtgcttgttctcgtagcagctattggtgagaaggttaatgtccttgttgcaagcaaaactaaagatgtccacgctggtaacatgatcaaaggattggcaccaattgtagcaggtcgtggtggtggtaaaccagacatggctatggcaggtggtagcgatgcaagtaaaattgcagagttgctagcagcagttgcagaaaatttataagaaacacctctcatttagttagtaaataaaacagacaaagggcagaacatcgttctgttcctttgtgtatataggagaaatatggttggtttaggaacagttatcaatgttattcttattatagttggaggctttgtaggtttatttttgaaaaattttttgaaagaatcacttcaaaagagccttatgcaagccatgggagttgcagttttatttatttcgatatcaggtgttttggagaaaatgatgttagtcgaaaagtcacatctcatctctaatcatacaaatatgatgattattactcttgctctaggtacggtacttggagagttgctatcactagattcgtatattgataaatttgggaactatcttaagcaaaaaacaggaagtggtaacgatattaaatttgtggaggcattcgtcacctcaacttgtaccgtttgtattggagcaatggccgttgttggtagcattcaagatggtatagcagcagatcattcgattttatttgctaagggaatgttagacatgattattattgcaattatgacagtgtctttagggaaaggagctctattttctgcacttcctgtcgctttactacaaggtagccttacgattgttgcttttttcatggggagtctacttaatccatcatctttagattaccttaacttagtaggaaatatgcttatattctgtgtcggtgttaatttactctttaacctaaatattaaagttatcaatatgttgccagcaattattttagctatattatggggaagttttatataaaagataaccaagttttaactcaaacttggtttttctttagacatatgttaggatgaaagaagatatactacggagaggatccaactcatgaatctattattttctattgatgatatgtacgtagatcattttaaagtgatgctttattcgcttgtccgacaaaccaagaatcgtaagttagagatatatgtcttacaaaaaacattactcaaacgtcatacagaacttattcaatatactcaaaatttagaagttggctatcatccaataattgtaggtaccgaagtatttgctcaggcacctacaactgatcgctatccagatacaatatattatcgacttttggctcataaatttttacctgagaccttagataggatactttatttagatgcagatatgctttgcttaaatgatttctcaagtttatatgatatggagttaggtgatcaactatatgcagcggcaagtcataatactgatggtaagtttctagattatgtcaataaattacggttaaaaaatgtagagctagaatcctcttatttcaatacaggggtactcttgatgaacttgcctgctatacgaaaagttgttcatcaacaaactatcttagattacataatgcaaaaccgtggtcgtctaatcttaccagatcaggatatcttaaatggcttatacgctaatttggttaaaccaatacctgatgaaatttataattatgatgctaggtatagtcttatttatcaattaaaaagtcgcaatgaatgggatttagagtgggttattaaccatactgtttttttacattttgcaggacgagataaaccatggaaaaaagattatagaggacgttactcgggcctttataagtttatggctaaagaggctttaactaaaaattgaagatttaaaaggttactaaattatttctatttagtaactttttttggggtgatattttaatgatatcaataatctttgctaataattatttataaaaaagaaaaataatatcaaaggaggagcgtgttaaaatcacttaatcattgaacaatcaaattaatcattgtttcaaaagcataatggttttaggagttactcaaatgaaaaaggaatttattattacaggtcggatggttgcaagagttatggaaaccctagtttgcttatgtatggtaagtaatcttgttcttgatatgcttgatataatagaaataaatgaaattgtattttgtgtgttggtagcatcaattgcagggcttgagttttgtttgcaaaaagaaagggagtagatagatggaattgtttggcttaatggctttttatggtcatgacgtatattggtgtacctaaagagcaaaaggcactcagtcgtaggggtaaacaattagaaaaaataaatcagggaggaaaaacacttatgtcacaaatgattcaagatttagtaggaagcacatgtatgatttatttagaggatggttctcaaactcatccttatgagattttaaaggtagatgaggattgggtacagattcgtcgcaacttgaaacgaagtaaagaggaggtgcgtattgtccgtattcatgatatcaaggaattgcgtccagtcaataaatagagcgaggaataaatctatatatcattttataaaggagaaaaatgatgggattaattttaaaaaatagactcaaagaattgcgtgcacgagatggtatcaatcaaacagaactcgctaaattaacaggagtctcaagacaaacaattagcctaattgaacgcggagaatatacgccatctgttattattgctatgaagatttctcaagtatttaaagaatccctagagaatgtttttagtttagtgtcaatggaggaataatgatgaaaaattttataaaacaaagtgatactacatttgttcgaattatcaaaagtcttttaattggtggttttataggggccatacttggttccgtaggagctctttttatcatatttggtcaagataagtacttatctgaaattaatattgttcaatatttcctatgggttagtcgtattgttgtaattataacagctctctttagtctcatctacctctatcagattcaaaaatatcagaaagtttttttcaatgttgatgaaagtcaatctgaagaaatttatcgccagattaatttaagacattcttatgggatgacttttgtgtcaatttcaatagtactcagtatagttaatactttatttaactataaactaaatatttttgatgattcagttactttagttattccaatatatgatttatcactgctatttgttttattgggtttacatatatattttttaaaggtatatcggaatatccgaggtataaaaatgacagtcgctccaactttaaaagagttgaaaaacaatgtcttacaattggacgaagcagagttggaatcaaattataagatgtgttttgatattgtcatgaatttaagtggttttattttccctacgatctattttgtattattctttatctcatttgtttttcaaaaagtggagattgtagcaattattataacaacatctattcatatctacattctcattaagtctttaaaagcagcacgtcatttttatagatagtagtagctagattttttatcaaaaaacttatattagtgtaaaataaaaggattgattctctgaaaatcagtccttttattttttctatttcttaggtaaaaagaagctagggtagctgataactaaaataataatactaatgactacaaaaaatagagttaacaaaccagcagtaccattgacgcttaatgagtataatgtagcagacataccttttggtgcataactagcccaaaaaataacaccagcgatataatgccaaacataacgaacaagtgttgctaatattgctccagataatgctaatgataaagctttagttttagagctgctgctaagtgcatctttaaatttagcagaaaatacgcctgcaagtcccatacttataaatgctaagatgtattctataaaaacttgggataaactaaggtaatatactttggaaagaacaaagtgcaataagccccaaattaagccagcaaatagaccgtattttgtaccacgacgtaatgcaaaaagtatcagaggaattgctccaaaagagggagtgaaccatgacgcaaaatcaggaatcattgataaagccatagcaagcgctgcaaaaatagcagtttcaataagacaggtagtgttgttattttttgacataaaaaatctcctttttttatacagcaaaggagattcttttgtcatttgtcatgtttaaccaattcaaaccacaattcctacgctcgtcctaacgagatcaggttagaggattttgcatatctgcaatctcagctcaaggcactcccttgtgtatttactctaacattctatcttgaaagggtttgcttgtcaagaaatttgtatttaactagaaaaagacactaaatcagtgtctttttcttataatccatagttatagtcatcatcatgcatagcttcaacgctaccaagtaggtaaccattacctacttgagagaagaagtcatggtttgatgttcctgttgaaataccattcataacaattgggttgacatcatttgctgtatctgggaataaaggatcttgtcctaaattcataagagctttattagcattgtagcgtaaaaaggtcataacttcttcagtccatcctacgccatcataaagtgtcttggtgtatttttcttcgttttcatacagctgataaaggaggtcatacatccaatcacgaaaattctcttgctcatcttctggtaattcgttaaaaccaagctggaatttgtaaccgatataagtaccatgtacagattcatcacgaataattaatttaatgatttcagcaacatttgctaacttattatttcccaaatagtaaagaggtgtgaaaaagccagaataaaaaaggaaagtttcgaggtaggtggaagccacctttttttgaagggcatttccattagcataaatgtcattgataatacgtgctttttcttgaaggaactcattattattagtccactcgaaaatttcttcaatttctgatttagtatttaaagttgagaaaattgaagaataagatttagcgtgaacagattccatgaattgaatattgtttaagacagcttcttcgtgaggcgtgcgaacatcggcacgaatagcttcaacaccagtttctgattgcatggtatcaagtagggttaagcctccaaaaaccttgccaacaagatctttttcttgagcagaaagtttgcgccaatcgtctaagtcatttgataaagggatacgtgtatcgagccaaaattgttcggttagtttttcccaagttgatttatcaataacatcttcaatttcgttccagtttatagcttcgtagtaagttgtcatggttttctccaatggtaaataggtttttatataatgatgatggaagaagagtagaatatagaattctgatctagcaatatttcaagtattatcgatttttagaaaaataaagatgaaaataccttagaaaataagataacatcatgaaactgagatagtttatctcagtctagtttctgatgttttaagtagagtttcttcgttagatgacacaactttcgcattgattagctccgacttcgctaccatcatctgtaaaagtacggatatagtagattgatttcacacctttgttgaaagcatagttgcgtaggattgaaaggtcgcgagtagtctgcttactttctgttttccactcgtacaactcctttggtaattcgcttcgtaaaaagagtgtcattgagagaccttggtctacgtgctcagttgctgcggcatagacgtctattactttacgcatatccatatcataggcagaagtgtaataagggatagtatctgtagctaagccattagctggataataaattttcccgatttttttctcttgacgctcttcaatacgttgtgtaatagggtggatagatgctgaacaatcgttgatatacgaaatagaaccattcggagcaactgcaagccgattttgatgatatagtccgtctttcataactgcgtatctaaggttttcccaatctttagcttcggggataaaatgattagcaaatagggattttactttgtcagattgtggaacaaattttccagatacatatttatcaaagtatgtaccgtcagcgtattttgatttttcaaaacctacaaatgttgtttgacgttcgcgggcaatattgtttgattctactaaggtccagtagttcattagcatgaaataaatatcagtaaattcaattgattctggactaccatattcgatatgattttttgccaaataggagtggagtcccattgctccaagtccaaatgtatgtgcttgagcatttccgtttttaatagttggaacagcttcaatatttgatgagtcagtaacgaaagttaaagcacgagtcattgttttaattgattttccaaaatcaggagatgtcatcatatttaaaacattagttgagccaaggttacaagaaatatcagttcccatttcaaggtattcttgagcatcattgataagacttggtttttgtacttgcaaaatctcagagcaaagatttgacatgataatttttccatcaacagggttagtacgattagcagtgtcaatattgatgatgtaaggataacctgattcttgttgaagtttagaaatctctgtttctaaatcacgagcattgatttttgttttagtgatattagggttagcgactaattcatcgtatttttcggtaatatcaatatagctgaaaggaacaccatattcacgttcgatactataaggactaaacaagtacatttcttgattgttacgtgctagttcatagaatttatcgggtacagtaatccctaatgacaatgttttaacacgtactttttcatcagcattttcttttttagttgataagaatgaaataatatctggatggaaaacgtcaaggtaaacaactccagcaccttggcgttgtccaagttggttggagtaagaaaaactgtcttcaaataatttcatgactggaacgactccagaagcagcaccagcaaaacctttgataggagctccagcctcacgaaggttactaagtgatattccaaccccaccaccaatacgagataattgaagagctgaattaatcgaacgaccaatagcattcatatcatcagttacttggattaagaaacatgagactaattctccgcgacgacttcgaccagcatttaaaaaacttggtgttgcaggttgatagcgttgtgaaatcatttctagagctaagtcagttgctagttcttcatcaccgtctgcaaaataaagagcgttaaagagaacgcgatcttcaatactttctaaatagtattctccatcatttgtttttaatgcatactgctgataaaacttataggctgccatgaaggatttaaaacgaaactttttatcgaagagtttggtagataattcttcaataaattcaggacgatatttattgaggaaagcttcttcaagataatcatacttaaggaggtaagcaattttatcagtgattgagtcaaaagcttttgaattaggctgtacgttttctttgaaaaaagcagttaaggcttctttatctttatggagtgggatttgtccattaacaggacggttaatttcattatttaggcgaaagtaagatacatcgccaatattttttaaactcattgaatttatcctcttaacttaacaatacaaaatgggaataaagcaattaattgctttattcccagactctaatttgcttaaacaagttcttttagtttgcttggttggaaacctgaaaaaacaacattaccagcttcaatcactggagccgcagaaaagccgagatttttcacatattcaattttttctggtttttcatcaatattaatttcttcaaaatcagcgccgtgctggtcaagaaatttcttagtcattttacattgcatacagttgtttttcgaaaaaacagtaatagctgccatgttgtcctcctaatttttttcatggtaatagcatataaaaaaagaatggaaaaagcaagtgttttatttctaacaaaacacaatatatagtgtcttaaaataaaatgagacactatatttcgttttttagggttagtttaaaagctttcagcctgttttccaattcctttcagaagaacataaaaaaatcatttttagaattctatttttaaattctaagactctcatttttaatatgaaaagctgtggaaaacattcaagtttttttctgtttgagacatttaatcttgaaaaataaaaagcaatatgttatacttttaacttgtaagggttaccaataggtgactcaaatatttacaaatgacaaaaggagaaccataatatggcttcaaaagatttccacattgttgcagaaacaggtattcacgcacgtccagctactttgcttgtccaaacagctagcaaatttgcttcagacatcacgcttgattacaaaggtaaagcagtaaaccttaaatcaatcatgggtgttatgagtcttggtgttggtcaaggtgctgatgttactatttcagcagaaggtgcagatgcagatgatgcaattgcagctatcgaagaaacaatgacaaaagaaggattggcataagaaaatgacagaaatgcttaaaggaatcgcagcctctgatggtgttgcagttgctaaagcatatctacttgtccaaccggatttgtcatttgagactgtaacagtcgaagatacaaacgcagaagaagctcgccttgatgttgcactccaagcttcacaagacgagctttctgttatccgtgagaaggcagtagaaagcttaggcgaagaagccgcagctgtatttgatgctcatttaatggttctttctgacccagaaatgattaatcaaattaaagagactattcgtgcaaaacaagtaaatgcagaaacaggtcttaaagaagtgactgatatgttcatcactatctttgaaggtatggaagataacccatacatgcaagaacgtgcagcagatatccgtgatgttgccaaacgtgtcttagcacatcttttgggtgttaaattaccaaacccagcaactatcaatgaagaatcaatcgttattgcacacgatttgacaccttctgatacagctcaattaaataaacaatttgttaaagcttttgtaacaaatattggagggcgtacaagtcactcagctattatggcacgtacactcgaaatcgcagctgttcttggtacaaatgatattactgaacgtgttcaagatggtcagttgattgctgttaatggtattactggtgaagttatcattgaaccaactgaagctcaaatttcagccttcaaggcagcaggtgaagcttatgccaaacaaaaagctgaatgggcacttcttaaggatgcacaaacagttactgctgatggtaaacattttgaattagctgctaatatcggtacacctaaagatgttgagggtgttaacgaaaatggagcagaagcagttggtctttaccgtacagagttcttatatatggattcacaagatttcccaacagaagatgagcaatatgaagcatataaagcagttcttgagggtatgaatggtaaaccagttgttgttcgtacaatggatatcggtggagataaagagcttccttactttgatcttccaaaagagatgaacccattcttaggattccgtgcattgcgtatttcaatttctgaaactggtgatgcaatgttccgcacacaaatccgagcacttcttcgtgcttcagttcatggacagctacgcatcatgttcccaatggttgctttgcttaaagaattccgtgctgctaaagctatatttgaagaagagaaagcgaacttgttagctgacggtgtagcagtagctgaaggcattgaagttggtattatgattgaaatcccagcggcagctatgcttgcagaccaatttgcaaaagaagttgatttcttctcaattggtactaatgatcttatccaatacacaatggctgcggaccgtatgaatgagcaagtttcatacctctatcaaccatacaatccatcaatccttcgtttgattaacaacgttatcaaagctgctcatgctgaaggtaaatgggcaggtatgtgtggtgagatggccggtgatcaaactgcggttccacttcttgttggtatgggattggatgaattctcaatgtcagcaacctcagtacttcgtacacgtagcttaatgaaaaaattggacacagctaaaatggaagaatacgctaatcgtgctctttcagagtgttcaactatggaagaagttatcgaacttcaaaaagaatacgttgactttgactgagaataataaaaaagtagggattaaaaaatctctacttttttattgaaagtttggatattgttaagtttctaagaaaaatatgtcagataattgaaataaatagataaagtgatagaataaacctattacaatgtaaaaggagatttactttgacaaaagaatatcaaaattatgtcaatggcgaatggaaatcatctgttaatcagattgagattttgtcaccaattgatgattcttcattgggattcgtgccagcgatgactcgagaagaagttgatcatgctatgaaagcgggtcgtgaggctttaccagcctgggctgctttgacagtatatgaacgtgcacaataccttcataaagccgcagacattattgaacgtgataaagaagaaattgctactgttttagcaaaagaaatttctaaagcttacaatgcttcagtaactgaggttgtaaggacagctgatcttattcgttatgcagcagaagaaggaattcgtttatcaacttcagctgacgaaggtggaaaaatggatgcttcaacaggtcataagttggctgttattcgtcgtcaaccagtaggtatcgttttagcaatcgcaccttataattaccctgttaacctctcaggatcaaaaattgcgccagctctaattggtggaaacgttgtgatgtttaaaccaccaacacaaggttcagtctcaggacttgttttagcaaaagcttttgcagaagcaggtcttccagcaggtgtctttaatactattacaggacgcggttctgagattggagattacattgttgagcatgaagaagttaattttattaactttacaggatcaacgccagttggaaaacgtattggtaagttagcaggaatgcgtccaattatgcttgagttgggtggtaaggatgcaggtgtcgtcttagctgatgctgaccttgacaacgctgctaaacaaatcgttgcaggtgcttatgattactccggacaacgctgtacggcaattaagcgtgtacttgtcgttgaagaagttgcagatgaattggcagaaaaaatatctgaaaatgtagcaaaattatcagtaggtgatccatttgataatgcaacggtgacaccggttattgatgataattcagccgactttattgaaagcttagtagtagatgcacgtcaaaaaggtgcgaaagaattgaatgaatttaaacgtgatggtcgtctattaactccaggattgtttgatcatgttactttagatatgaaactagcttgggaagagccttttggaccaattctcccaattattcgtgtcaaggatgcagaagaagctgttgctattgccaacaaatctgattttggattacaatcatcagtctttacacgtgatttccaaaaagcatttgatatagcaaataaacttgaagttggtacagttcacattaacaataagactggacgtggtcctgataatttcccattcttaggactcaaaggatctggtgcaggtgttcaaggtatcagatattcaattgaagcaatgacaaatgtaaaatcgatagtttttgatatgaaatagacgtaaaacgactcaactattgtcagttgagtcgttttataaacctcttttacattaaaaataaagaattatataatcttctaaagtggttttatttttgtgatataattgtcataaaaaataacaaaagagtcattatatgaagaaattaattataggtatttttagtctaattattatagcgattcttgcttggcaaggtttttcgtttttgaaacataaagaaataaaacttcaacaagctgttgttgaaaaagaaattcgcatagccgagaaaacggtagaagtggtgaaaagacagaaaactgaacgtgttctttttcttgaacctaaaggatatgacaaaagtctaagcgctgatattttaaagtggaatcaaaaaagctttgagcataaaaaattttatgacaatcaatacattattctacgtcctcaattagcagattctaactttgcaaatgttaaaaaattatccatttatcaaatcttatatcaaaaagaaaaaggaagtatgtttcaaaaatcaagtcgccttttgagaacctacttacttgatcaaaataagaaaccttttgaattagatgagcttttagctcataatatatctggatttaaggctattttagaaaatatagctccaggaactcaactaaaggaacatgatagcaataaagaatttttaaaaactggaagagtaacagatgggctagatgttaaagatggtaagttaattattaatgatttaaaattaccacttgataaattatataatgtgatcgatgagtcatatttaaaatcaagtgatctagatttagtttctaatttaaaagctaaagcaccacgtgttgcacttacctttgatgatggaccaaatgaaaaaacgactcctaaagccttagaaatccttaaaagatataatgctaaagcgactttctttgtaatgggacaaagtgctgtagggcacacagatattttacaaaggatgcatgctgaaggtcatgagattggtaatcatacatgggatcatcctaatttaaccaaactaccagcggagaaaatcaaggaagagattcataagactaatgatctgattatgaaagcaacaggacaaaaaccggtgtacttacgtcccccttacggagcaacaaatgctactgtaaaaacagtgacaggattgaaagaaatgttgtggtcagttgatacagaagactggaaaaatcataatacacaagcaatgatgaccaatatcaaaaaacaattacgtcctggaggagtgattttgatgcatgatattcaccagacaaccatagatgctctgcctacaattatggattatctgacaacccagggctattattttgttactgtaggtgaattatattcaacgccttaataaaaaaagaaacaagttacttgtttctttttttattttaaatgtaatttttgattgtgaagtacaagttctgtaacggtggcgtattttttaagttgtttgagctcttctttatgtgttacaaatgtaataacacatccctctttccccatacgaccagttcgtccagaacgatgtgtatatgtttctttgtcgcgtgcgatatcaaaattaatcacatattctaggttgtcgatatcaatgccacgagctaccaaatcagttcctaggagtaatgaaatatcatggtttttaaatttctctaagataactttacggaatttaatattaatatcgcttgctaaagaaactgccgaggccctattaaattgtaaacgttcttcacatgcacctaagtctgataagctgttaaaaaagacaagacctctaaaatcaggaatatttgaaaatttacgaagtaggtcagtacgctctcttttatcaactgtaatataataatgttttatagtatcaagtttttgattagatagatcgattgttatagtgttatcggcaagtttactattgtccagtttgttggtggcactaatgtaaatcatttgctgatcacgaggaacgcgattaataatattgtccacaaaatgatattgtgagtcgccgagtaattcatcgaattcatcaaggacgatagtattaatgttcatcatttttattttttttagtttcacaagttcaaatacgcgtccagcagttcctataagaatttctggtcctttttttagtcgctcaatttggcgtttttgactagaacctgaaaggaatagttgtgcggtcagtcctaatggttcagcccattcttttgtaacgtcgaagatttgtccagctaattctgaatttggagctaaaattaagagttgttggctctttttaggttgcaacttaagaagcgttgggaaaaggtatgctagagttttaccagtacctgtagggctaattccaaggatattatcaccatcagtaataggttgaaaaagtttattttgaatatctgttagatcatcaaattgacgctgggttaatttatcctgccattggtctggaaattttgttatcataagaatcctcttgttattttatatattatcattgttattataacatgctttttatttttagagcgttttcaataaaatttagactttaaaaaaaataagtttatagtacaatagatagaggataaatttaatttggagtgacaaatgcgtaaaaaacctattattattggtgttacaggtggatctggtggtggtaaaaccagtgtttctcgggcgattttatcaaatttcccagatcaaaaaattaccatgattgaacatgattcttactataaagatcaaagtcatttaacttttgaagaacgtgtaaaaaccaattatgatcatccccttgcttttgataccaatttgatgattgagcaattgaacgaattgattgagggacgtccggtcgatattccggtttatgattacacaaaacatacccgtagtgatagaactatccgccaagaaccccaggatgtcattattgttgagggaattttggtattagaagatcagcgtttgcgtgatttaatggatatcaaattatttgttgatacagatgatgatattcgtattattcgtcgtattaagcgtgatatggaagagcgcgatagaagtttagatagtattattgaacagtatacagaagttgtaaaacctatgtatcatcaatttatcgaaccaacaaagcgttatgcggatattgtaattccagaaggagtaagtaatattgtcgctattgatttaatcaataccaaagtggctagcatcttaaatgaagcaaaataaacacaatggtttgtgtttatttttttgttttatataggatggttatttagttttagtaactttcaaattatgctataataagtgctatgaacaagtctaagaaaatcgaaaattatcaattattattactacaagcgcaagctctattctcagatgaaacaaatgctcttgccaacttatcaaatgcttcagctatgctaaatgctatgcttccaaattctgtatttacaggcttttatttatttgatggagaagagttaattcttggccctttccagggtggtgtatcatgtgtgcatattactttaggaaaaggtgtttgtggtgaatctgcacaaactgctaagacgctgatcgttgatgatgttacaaagcatgctaactatatctcctgtgattcaaaagctatgagtgaaatcgtagtacctatgtttaaaaatggcaaacttctaggagttctagatttagattcttctttagtagcagattatgatgagattgatcaagaatacttagaaaaatttgtaggtattctagtagaacatacgatttggaatttggatatgtttggagttgaaaagtaatgtatcaggccctttatcggaaatatcgtagccaaacatttgatgaaatggttggacaaagtgttatttcaactactttaaagcaagctgtgtccagcaaaaaaattagccatgcttaccttttttcaggacctaggggaactggaaaaacaagtgctgctaaaatatttgcaaaagcgatgaattgcccaaatcaaattaatggcgaaccttgtaatcattgtgatatttgtcgagatattacaaatggtagtttagaggatgtcattgaaattgatgctgcgtcaaataatggtgtcgatgaaattcgtgatatcagggacaaatcaacttatgctccaagtagggcaacctataaagtttatattattgatgaggttcatatgttgtctacaggtgccttcaatgcactattgaaaacacttgaagagccaacagaaaatgttgtttttatattagcaacaacagaactccataaaatccctgcaacaatcttatctcgtgtccagcgctttgaatttaaagcgattaaattattagctattcgagatcatttagcacagattttagataaagaagctatttcatatgatttggatgctctgacactagtcgctagacgagccgaaggtggtatgcgtgatgctttatcaattctcgatcaagccttgagtttagcgaaagataaccacatttctttagatgtagcagaagaaattacagggagcatttccttatctgctatagatgattatgtatcgaatatattggctcacgatacaactgaagcactcgctaaacttgaagtaatctttgatagtggcaaaagtatgagtcgttttgcaacagatttattgatgtacttaagagatttacttgttgttcaagcaggtggtgaagatagtcattcaagtgatacttttatagccaatcttaatgttaaacaagatattttatttgaaatgattgataaagtgacatctgttcttcctgagataaaaaatggtagccatcctaaagtttatgcagagatgatgaccatccaattgtctgaaatggtagaaaaaaattcgtcaaacatacccgcagatgtgacagcagaattagatagtcttcgtcgagagttaaaatcgttaaaaaacgaaatgagccaactctctcgagcagatcaaagttcatcaactcaaaaagtaaaggttaataataagacattcacatttaaagttgaccgtacaaagattttgaccattatggaagaaacggttgtagatagtcaacgttcacgtgaatacttagaagctttaaagagcgcttggaacgagatattagataatattacggctcaagatagagccttattaatgggatctgaacctgtcttagctaatagcgagaatgctattttggcatttgatgcggcctttaatgctgaacaagctatgaaacgtaccgatctcaatgatatatttggtaatattatgagtaaagcagcaggtttttcacctaatattttagctgtacctagaaatgattttaatcaaattcggagcgattttgcaaagaaaatgaaagctcaaaagacggaaacagaacctgaagttaatcatcaaattccagaagacttttcttatctagcagaacgaatagcaatcgttgaagattaaaacgtaactaaaaatagttgcctgttacaggcaactatttttttgataagttttttaattatttagtagattctgttataatggtgatatgacaaaacgacaatttatttttatggcgcttttatgctcttttgaaacttatttttttaatcaatccgttatggatggctcctggatttttgctattttttggggagttttattacttcgagatcttcaaaaggtgtatgcgatttcaaaattcacaaaagagcttatcaaatctaccaagaagaaagactgatttcgccactgcgaagtgttttcaactgaccatcatctaactcaaccactaaatatcctttatctgtaatatcaatagctttcccagaatacattgtttgaccatccataaagctaacggttctatctaagactagggatttttctctatatacctttaagtgatcctctagtggaatattgaaaaagagattccagatttctgtaatcaattgatttctagttatggtcggttgctctgtaaagagactacctgcgcgcttagttaacgccctagggaactctttgatatagaaattgatacctaatcctataataacattcgttaccaacccactctcaacagaagcgatagcctcggttaaaataccagctatttttttattatctaaataaatatcattgacccacttaatttcaggagtaattcctgttaaccgtgagatagcttttacagcactagaggctaccatgacagtataaggttttatatcttcaatcggtacattaggttgtaataaaagagacatatagatgccgccttgatttgatgtaaagaaaggtctatcaaaacgtcctttagcttttttttgattaggagctaaaaaaaggtgtggagtctttaatttactttctatccccattttagcatctagttgggttgaagcactattattattaagactaaccttaataccaatttcttgttcgagttgttctggtaataatatgtcacctgataccaatcggtagcccttgttagtgacagactcaatctctaggcctaattcttctaacgtttttatacctttccaaatagctgtgcgggaaatattaagttgatttgccatagtttctccgctaataaagttgttattttttgatagtatttgataaattttttcgtaggttttcataaatctagtatagtataaatcgagaaaaaagactaaagaaaatagagatatttttttatttattggtaacttatttcacaaaagatgaaatagtggtacaatagctatatgagtcccgaaaaggtagcctagaggctagttctttgtaactcgacacattttacattttaggggggacatttttatgtcagaacgtaaacttttcacgtctgagtcagtatctgagggacatcctgataagattgctgaccaaatttccgatgcgattttagatgcaattttagagcaagatccagatgcccacgtagcagccgaaacagctgtttatacagggtcggttcatgtatttggcgaaatatcaacgacagcctatgttgatattaaccgagttgtccgtaacacaatcgctgaaattggctatgataaagctgaatatggcttctcagctgaatctgttggagtgcatccgtcactcgttgaacagtcgccagacattgcacagggagtcaatgaagctcttgaggtacgtggttctcttgaacaagatcctttagatttaattggtgcaggtgaccaaggtttgatgtttgggtttgctgttgatgaaacacctgagttaatgccattgccaatttctttagctcatcagttagttaagaaattgacagatctacgtaagtctggggaactcacttatcttcgaccagatgcaaaatctcaagtaacggttgaatatgatgaaaatgatcaaccaattcgtgtggatgcagtagttatttcgacacagcatgatcctaatgtaactaatgaccaactccataaggacgtgattgagaaagttatcaatgaagttattccaagccattatttagatgaccaaacaaaattctttatcaatcctacagggcgctttgttattggaggccctcaaggagattcaggactaacaggtcgtaagattattgtagatacttatggtggttattctcgtcatggtggtggtgcattttcaggtaaagatgctactaaagtagatcgttcagcatcttatgcagctcgttatattgcaaaaaatattgttgcagctgatttagctaaaaaagtagaagtacaacttgcttatgcaattggtgttgcccagcctgtctctgtgcgtgtagatacatttggaacaggtgttatagcagaagcagacctagaggcagctgtacgtcaaatatttgatttgcgaccagcaggcattattaatatgttggacctcaaacgacctatttatcgacaaacagcagcctatgggcatatgggacgtactgatatcgatttgccatgggagcgagttgataaagtccaggccttaaaggattttattgctagcaaataataaaaagcgtaaacgaaagtttacgctttttttgctcatgataatttatagaacatttataaaatcttataataaactggttaagtataggaaatactgcatatttcttgaaaatatggtgtatattgtgaataaaatgatggccaagttaattgaattttcctatcgaaaaatttttcaaaaaaataatttcacactcaaatcatttgattatcaaataaatatagcctttataaaaatattatataagtataaaatgtaaaaaaaataaaaaaatgatatttttatttgatttaaatgtatttaataaaaatacaaagtttctaaaaaaagtaaaaattccatctcgacaaacagcgttagttattataaccgaacattattgtccttaaagcatgaaaacaaaaacaaaagttcgtaatttaattgatttgccatgttactaatcttatgctaatatattatctcgtgataagtttttgatgtaaaaattatcatgaaaaagaaaagagagatggaaatgaaaaaacaatttttaaaatcagcagcgattctatcgctagcagtaacagcagtatctacaagtcagccggtaggggcgatagtgggaaaagatgaaacgaaattaagacagcaacttgggtatattgattcaaaaaaatctggaaagaaaattgatgagagatggggtgaaaaaatttataactatctaagttatgagctcattgaagcaaacgaatggattaaccgaagtgagtttcaggaacctgagtatagaactattttatcagaatttaaagataaaatagatagtattgaatactacttaattaacttaagtaatattgctaaagaagatgcgcatcaaagaaatattcttcaatcattagataaatatgaaaaaagtggaatatataatttagaccaaggtgtttataattatatatatcaagaaattagttcagcgaagcacaagttttcggatggggtagataaaatttatcgtttagatagtactttatttcctttctctgtatggtatgataaacatttagataataatgataactacaaggataataaagattttaaagagtacattgctttattaaatgaaattacacgaaaagcaaggttaggatatcaaattgtaaataaccataaagatggggagcataaagatgaagcagaaatactggatattttaatcagagatataacttttgtttcaaaagatgctcctggatataaatatattccaaataaaagaattgcagcgaaaataattgaagatttagatggaattatcaatgacttttttaagaatacaggaaaagataagccttctcttgaaaagttaaaggacacagaattccataaaaaatatcttaattcaactgaaccgtatagtattgaaactaacttaccttcaaattataaagaattgaaggaaaagcaaataaaaaaattggaatatggatacaaaaagtcttctaaaatttatacgtctgctcattatgcactatatagtgaagaaattgatgctgcaaaagaattgcttcaaaaagtgaagattgcaaaagataattataatgaaattaagtccatgaatctaagcccttcaatttttaatcagtatttacaacttcttcaaatagttataagttcagagataaatctaaaaaaggcactcgataacactgtggatttacccatagaaaataattttaatacattggacattcaatataataaattagacactgctattaagtcacttcgaaaatttgtaactaagtataaacaagaagtaagaaaagctactaagagttattctaaaaaagaattagtaaatgcagagttaacaaaagtaatttctaatgacaatattttattagacatgcaagcaattagttccaattatgggtctactaaaaagtttgtttattcagtcaaaagattaccttacgtcccgcaagtaattatgacaacaacgtctaatgtacttatgcctcaaaagcaagttgaaaaagtgaagctactcaccccatttacaatttctaataaagaagtattgaatcatgactcactagtagaaaatgatgctcaaaaacaaaaagtagaacaggaaaaaactaaatcgctagctcctcaaaaaggggctgtaaaagaacaaactgagcaaaaagtatctggaaatactcaagagatagaaaagaaatctgaaactgtggcaactccacaacaaagttcagttgcgcaaacttctgtccaacagccggctccggttcaatcagttgttcaagaatccaaagcttctcaagaggagattaatgcagcacacgatgctatttcggcgtataaatcaacagtcaatattgctaatacagccggtgtaacaactgcggaaatgaccacgctcattaatactcaaacttctaatctttctgatgttgagaaagctttaggaaataataaggttaataatggtgcagtcaatgtattgagagaagatacagctcgtcttgagaatatgatttggaatcgtgcttaccaagctattgaagaattcaacgtcgctcgtaatacttataataaccaaatcaagacagaaacagttccagttgataatgatattgaagctattttagcaggttctcaagctaaaattagccatttggacaatcgtatcggagcgcgccacatggatcaagcttttgtagctagtttattagaagttactgagatgagtaaatcaatctcatcgcgtataaaagagtagacactgctatcaaggcgatcttaaacttttgtattaaactaacctaaaagatagaaagagactaatatgaaaaaaataacaactttaatcttagctagtagcttattactagttgcaacgacatcggttaaagctgatgataactttgaaatgccaacgcgttatgttaaaatgagtgaaaaatcaaaagcattttatcaaagactacaagaaaaacaacgtaaggcacatactactgtgaagacttttaataattcagaaataaggcatcaactacctcttaaacaagaaaaggctagaaatgatatctacaatttaggcattcttatttctcaggagtctaaagggttcatccaacgtattgataatgcctattctttggaaaatgtctcagatattgttaatgaagctcaggctttgtataaacgtaactatgatttatttgaaaaaatcaaatctacacgtgataaggttcaagtcttacttgcatcgcatcaagataatacagacttaaaaaacttttatgctgagttggacgatatgtatgaacatgtttatctcaatgaaagtagagtggaggcgataaacagaaatatccaaaaatataattagtttctaaactaacaaacattcctaaatataagacataaaaccctactcattgattagtgagtagggttttactgttttaaatagctttctgatcagaatgtaagccttgtcatttcaaaggaactatgttattattcttaagtaaattaaataggacatttggggtgcgtaacagctgagattatacccattgaacttgatgcagttagtactgtcgaagggaaatgtgtgccattacaagttttttgtggtggaaaagggcgtagtgtcttcttagtagacagctagctctagttaatcagataataaactccgtttgcttgcagatggagttttttgttgtcaaaattttttgtaggttgttgccccttatctgtcatagagaaggagttatgatgactaatcataaaacaaaaaaattaacggttttagcaattatgattgctttagatgtttttttaacgcccatttttagaatagaaggcatggcctttatgtctagtgtggttaatattatcgctggagttataatgggaccaatctatgcattagttatggcacttgtaacggcttttattcgtattttaactcaagcaggagtagcatctgttgcacctttagctattctaggagctggtccaggagctttcttagcgggttggttttatcggttttatgcgaaagactggatgtcttgggtgggtgagtttataggaacagggataattggagcacttttatcagctccaattatggtctggttttggacttggacagcggatggaaatcacgaagtgttagctaaagcatctgcagctcaatccatttttctttttatgccaaggtttataggggcgactataattggcggtgttattgctttgttgctacttcagggattaaagcgggttcctgtatttatgacaatacaagcattatttaaaggagaaaaagtaaaatgaaattgagtttaaaagatgtattattgattgctctattagcggttgttctgggcgttgtttactttggagcaggctatatttcaaatgcttttgtaccttttgtaggccctatagcgcatgaagttatttatggtatttggtttgtggcaggtccaatggctctttatatattgaggaaaccaggaaccgctattgtagcagaattgttagctgctttgatagaggttttaattggatcaatttatggaccaagtgtactcgttattggtacccttcaaggtttagggtcagaattaggctttacactatttaggtatcataattacaagttgccagcttttatattgtctgctattttgacatcaatttttagttttgcatggagtttttatgccaatggacttagtgcgttttcattttcatataacattctgatgcttatagtaagaactgtttcatctattattttcttcttattaacaaagaatatatgcgaccaattgcatagaagtggtgtactgaatgcttatgggattcatgaaaggaagtagcctatgctatctgttgaaaaattagcttgcacccatggcgatagtcattatttatttgatgaagtgacttttagtcttaacccaggagaacgaattttaatcagtggctattcagggtgtggtaagagtacattggctcttttactatcagggttaaaagaaagtgggaaaggtcaagttttattaaacggctcattaatagaaccaagcgatgtggggtttctttttcaaaatcctgatttgcaattttgtatggatactgtggcgcatgagttgtattttattttagaaaatttacaaatagaaccggagcaaatgcaagatagaagtgagtttgtattggcacaagttggtttaaaaggatttcagaatcggttgatttatactttatctcaaggtgaaaaacagcgattagcattggcgaccatttttttaaaatctcctaaacttattattttagatgaagcttttgcgaatttggatcaagagagtgccagtcaactattacaattagttcttaattatcaagcaaacaatcaatcaatgctgattgtaatcgatcatttgattacttattatcaagatataatggatcactatttttggttggaaaaacggttgacaagggtcaattttgattatatgctcaatcgtttgaatgtcttcgaattagaaaagaaaagtcataatacaggtgacaaactgttatcaattaaagatttccaagttaaactttcaaaaaacaaattcatctcttaccttgattttgatttagcaagtggggagaggttgtgcttagatggaccaagtggcgtggggaagtctagtttgtttatgggattgttagggctttataggactaaagggaaaaaacaatttactcatagaaagcaaattcctataagctttttatttcaaaatcccttagaccaatttattttttcaacagtttatgacgaaatttttcaggtttgcaaggatagtaacaaagcgagggatattttggaaaccataaatctttgggataagaaacagttttcaccatttcaactaagtcaaggccaacagaggcgattagccattggcagtattttagctagtgatagtaaacttctattattagatgaaccaacttatggacaagatgcctatcacgctaatatgattacaactcttcttttgagttattgtcacaaaaatcattgtggggttatttttactagccatgatcctcacttaaaagagtgttttgcaacacgtttcttggaggtgtcatcttgttcaatttgaaaaactatcatccagctattaccttcctatgtttattaataccaaccttttcgtttagtttcacattgaggttaagaacgtctttgttatttctaattatagtagtaacactgcaatgcttcgtaaaggtttctttaaaaacttgggcgaaggtcaatctgatatcatttgtgatgggactctctttatttctagggacgtatttttggggaaaattaccccatcaattcgtcttagctagtctagtggcctgtcgtccgcttatttttatgaacgtgggtttgttatttcatgcatcacattctaattatgattttatagaatctctttatcaaactttcaaagtgcctagtcattttgcatatggtatttttgcggtctttaatcttctaccattaattaaattacaataccaacgtaatcgactcgcattccgactgaagaatcaggtaacttgggcattatcgcctagactaatattgtcagttttattaaagacgatatattgggtagaacagttagagttagcaatgctttctaaaggttttgaagtgggtaaagagcgaacacatgcttcaacttatcccgttcgttttcgagattatagtttacttggtatgagtattttattgtctataggaatgatttttaaataagtacaattagtttagtaatacaattgtgcatttatatagaatgagcgtgttctgctcatgagatcataacaaaggagattactatgttaaaagataagatgattgctaaaggagcaaaatatatccaatccatctatcaagatccatttattcaaggaattataaaagggcgtttagaccatgacgtaatctgccattatttacaggcagataatatctaccttgggaaatttgctgatatttatgccctgtgcttggcaaaatctgataatttacgagataaacaatttttccttgaacaaattgactttacattaaatcgggagttagcagatggtgaaggcccacatcaagccttggccgcttatactaatcgatcttatcaggatattatcgaaaagggtgtatggtacccgtcagcagatcattacattaaacatatgtattttcatttttacgaaaatggtattgctggtgctttagctgcaatgagcccatgtccatggatttaccatcaattggctaaaaaaataattgaggagaaccagtttttgaatggtaacccttttaataattggataactttttatgctaacgatacagttgaagagttaatggaaaactattttcgtatgatggattattatgcgcagaatttgtcaaaagagaagcaagctgatttggtagatgcttttgtgaaatcttgtcagcatgagagacgtttttttcaaatggcaataaatcaagaaaaatgggaggattaatatgacttatttagcaccagttttaactattgcaggaactgatcctagcggtggagcagggattatggcggatttaaagacatttcaagctcgtcggacttacgggatggctgttgtgactagtgttgttgctcagaacacttgtggggttagaggcgttcagcatatagaaacagctatcattgatcaacaactagcttgtgtctatgatgatattaagccaaaggcggttaaaacaggaatgttagcggagagggaaacaattagtttagtcgcttcatatttaaaaaaatatccgcaaccttatgtattagatcctgttatggtggcaactagcggacatcgtttaattgattcagatgccgtagaagcattaaaagaagacttattgccattagcaactattatcacaccaaatttaccagaagctgaggttttagtgggatatgacttatcagatgaagtaagtattattaaagcaggttacgatattcaaaaacaatattctgttagaaatgttcttataaagggaggacatctagatggcttggctaaagattatttatttttggaaaaagaagggttgataactcttagtaatcaacgtatcaatactattcatactcatgggactgggtgtacatttgcagcagtcgttgcagcggagttagctaaagggcaatcaattctaaacgcggtaagtaccgctaaatcatttattacttcagctatcgaaacagcgcctgagttgggccttggaaacggtcctgtcaatcatactagctatcaaggagactaaaatgtatttagaacaattaaaagaggtaaatcctttaaccatttgtatcactaataatgtggtcaaaaactttacagccaatggtttattagctttaggagcttctccggctatgagcgagtgcatagaggacttagaagacttgttaaaagttgcagatgcattattaattaatataggaacactaacaaaagaaagttggcaactttaccaagaagcaatcaaaatagcaaataaaaaccaagttccagttgtattagatcctgtagcggcaggagcaagtcgttttcgattagaagtgtcacttgatttattgaagaattattctattagtttacttacaggaaatggtagtgaaatcgctgctttgattggtgaaaaacaagcgtctaaaggggcagatggcggaaaagtggctgatttagaatcaattgctgtaaaagccaatcaagtttttgatgtgccagtggttgtcacaggagaaactgatgctatcgctgttagaggagaagttcgcttattacaaaatggtagtcctttaatgccacttgttacaggaactggatgtctattaggggcagtattggctgcttttattggtagttctgacagaagcgatgatcttgcttgtctgacagaggccatgactgtttataatgttgctggagaaattgcagagaaggtggcaaaaggtaagggggtgggaagtttccaagttgcatttttagatgccctttcccagatgaaatcagaaatgattatggacaaataggtggtgtcagtagatgaaagatacattgaaattatattttgtttgtggaactgtggattgctctaggaagaatatattgactgttgttgaagaagccttacaagcaggtataactctatttcaatttagagaaaaaggttttacagcattacaaggtaaggaaaaaattgctatggctaagcaactccaaatactttgtaagcaatatcaagttccttttattattgatgatgacattgacttagttgagttaattgatgctgatggtcttcatattggacaaaatgatttacctgttgatgaggcacggagacgtttaccagataaaatcatcggtttatctgtgagtacaatggatgaatatcagaaatcacaattatctgttgttgattacatcggaattggtccttttaatccgacacaatcaaaagcagatgctaagcctgctgttggcaataggacaacaaaggcagttagagaaattaatcaagatattccaatcgttgcaataggcggaatcactagtgattttgttcatgatattatagaatcaggtgcagatgggattgctgttatatcggctatttcaaaagcaaatcatattgtagatgcaaccagacaattgcgttatgaagttgaaaaagctctggttaataggcaaaaacacagtgatgtaatcaaataaggctacatcgttaattataagaatttttaagatattatatcatcacacaatactggtatttgaaaaagaatttaaactatgataatatagtagagttgaattctagttaaagaaagatttgaaagtatgcgtaaaattattattaacggtggcaagcaactgacgggagaagttgctgtatcgggtgccaaaaatagtgtagttgccttgattcctgccactattcttgctgatgatgttgtggtcttagatggagttccggctatttctgatgttgacagtttagttgacattatggaaactatgggagctaagattaagcgttatggtgagacgcttgaaattgatccatgtggcgttaaagatattccaatgccttatggcaaaatcaatagtcttcgtgcatcctattatttctatggaagcttattggggcgttatggtcaagcaacattaggtttacctggtggttgtgatttaggcccccgtccgattgatttacatttaaaagcttttgaagcgatgggagctagtgtttcttatgaaggtgattcaatgcgtctagcaacaaacggaaagcctttgcaaggagcaaatatttatatggatactgtcagtgttggtgcgacaattaacactataatcgcagcagctaaggcaaatggccgtacggttattgaaaatgctgcacgtgaaccagaaattattgacgtggctactcttttaaataatatgggagctcatattcgtggtgctgggactgatgttattacaattgaaggtgtgaaatcgctccatggcacgcgtcatcaagtaattccagatcgtattgaagcaggaacttatattgctatggcagcagctatcggacgaggaataaaagtgaccaatgtgttatatgaacaccttgagagtttcattgctaagttagatgagatgggagttcgaatgacagttgaagaggattcaatttttgtcgaagaacaagaaaggttaaaagctgtatccataaaaacctcaccttacccaggatttgctacagatttacaacaacctctaactcctttattactaacagcagaaggaaacgggagtttattagatactatctatgagaaacgtgttaatcatgttcccgaattagcacgtatgggagctaatatttctaccctagggggcaaaatagtttatagtggtcctaatcaattatctggtgcacctgtaaaagcgacagatttgcgtgcaggcgctgctttagttatcgctggcttaatggcagagggacgaactgaaattacgaatatcgagtttattttacgtggatattctaatatcatcgagaaactaacatcattgggtgcggatatccaattggttgaggaatagtatatataacaaagagttgagaatatttcttagctcttttcttcttgttttagattaagtcacttataggtatttgaaatctcttgtggtataatattatcatggatatatggacaaatttaggacggtttgcattcattgaaacagaacatgttaacctacgtcctgttgcctacactgatagggaagctttttggcgaatagcttcaaaaaggacaaatttacaatttatttttcctgttcaaaccagtaagaaggaaagtgattttcttttagttcattcttttatgaaagagccattgggagtttgggcgattgaagataaagttagtcataaaatgtttggagttatccgttttgaaaacattgatttatctaaaaagacagctgaaattggctattttttgaaagaaagttcttggggtcaaggcattatgactgaatgtctaaagacactttctttttttgcttttcgagagtttgggatggacaaattgatcatagtaacacataaagagaatattgctagtcagaaggttgctttgaaggcgcatttcaaacaatctaggagttttaaaggaagcgaccgttacacacgccgtataagagactatattgagtttcaattaactaggggtgattatcgttatgagtaaacatcaagaaattttggagtacctagaaaatttagctgttggtaagagggttagtgtacgcagtatttcaaatcatttaaaggtgagtgatggcactgcataccgcgctataaaagaggcagaaaataggggtattgttgagactagaccgcgtagtgggacagtacgtgttgctcaaaaagcaaaggttaatattgaaaaactgacttatgctgaaattgcaaggattagtgactcacaagttgttgcaggaatagagggactcagcaaggagtttagtaaattttctataggtgcaatgactcacagaaatattgaaaaatatttggtgcaaggagggttattgattgttggcgaccgtgatgagatacaacatttagccttacaacatcaaaacgctatcttagttacaggtggctttaatgtttccccatctgtttgtcgtttagcagataaacttcaaattcccgtaatggtaacacactatgatacattcacagtatcaacgatgattaatcacactttgtcaaatgccaaaattcgtactgatttaaagaccgttgaacaagtctatcagtcgcaaatggattacggtttcttagcgcaggatgataccgtaaaagaatttaatcttcttgttaaacaaactaaaaatgttcgttttccaatagtcaaccaagctaatgttgtcgttggtgttgttagtgttcaagatattcttggaaaagataaagaagtaaaattggcaacagtcatgtcaaaaaatatcattgttgctaaacctcgaatgagtctagctaatatcagtcaaaaaatgatttttgaagatttgaatatgatgccagtagtatcggatgactttgaattattaggcgttattacaagacgacaagctgtagaaaatttatcgatgtcgcaagggacggatttatacacctatagtgatcaaatcttgtctaatttacaaattgaagatggtcacttttcgtttttagtagaacccgctatgattgaccatacaggtagcttaacacaaggagttttgacggagttcttaaaagaaatttgtattcgtgtcttaactcgtaagcatcaacgcagtattgttgttaaacaaatgacactttatttcttgcaacctgttcaaattgatgaaataataatggtaacgccaacaattatttcagaaaaacggcgcgaagctacactcgatttagaattaaaattagaaaataaaattattgctaaagctatgatagcggtaaaaattaattagatataaggagaataaatagaaaatgattacattaaagtcagcacgcgaaattgaagcaatggatagagcaggtgattttttagccagcatccacattggacttcgtgatattatcaaaccaggagttgatatgtgggaagttgaagaatacgttcgtagacgttgtaaagaagaaaacgtattgccattgcaaatcggggttgatggtgcagttatggattacccatatgctacttgttgtgggcttaatgatgaagtggctcatgcctttcctcgtcattataccctaaaacaaggtgaccttttaaaagtagatatggttttaagcgaacctttagataaatcaattgttgacgtttcatcgttaaactttgacaacgtggctcaaatgaaaaagtacacggaaacatatagtggtggtttggcagactcgtgttgggcttatgctgtaggtgaagtttcacaagaggtgaaagacttaatgtctgtgacaagagaagcaatgtatattgggattgaaaaagcagttatcggaaaccgcattggtgatattggagctgctattcaggattatgcagagagtcgtggttatggagttgttcgtgatttggttggtcacggtgttggtccaacaatgcatgaagagcctatggtgcctaactatggtacagcaggtcgaggtctccgtcttcgtgaggggatggttttaaccatcgaaccaatgattaatactggtacttgggaaattgatacagacatgaaaactggttgggcacataaaaccttagatggtggtctttcttgtcaatatgaacatcaatttgttatcactaaagatggtcctgttattttaacgagtcaaggagaagaaagaacttactaaaatgaaattaaaaaaattctttgaggatttgctggctaaactagaatatagacccattcaagtttttatgcgtcattttcaaagtgcagagatggacttatcagccatagcagttgcttattatctattagtgacagcttttccattactagttattgctgctaatatttttccttattttcatattaatgtgtcggatttattgtcacttatgcaaaaaaatcttccgaaaaatatttatgaacctgcctcacgcttagcagtagatgctttttcgaaaccgtctaccggcattttgggattcgcgtcattaacagctttttggacaatgtctaaaagtttgacctctcttcaaaaagccattaataaagcatacggtgttgaccaacacagagactttgtgattagtcgtttagtgggtgtggggactgggctgatcatcctatttttactgacttttgttttaattttttcaaccttttcaaaaccagttttacagataattgtaaacatgtatgatttgggagatactctaacggcgtggcttttaaatcttgcacaaccagttacatttttgactatatttttaggtattggaattttatactttattttacctaacgcacgaattagaaaagtacgttatgtcattccagggacattattttcaacgtttgttattggtttttttagtaatttaattagccaatacgtcttaaatagggttgagaaaatggtagatattaaaacgtttggttcggtcgttatctttatcttaatgctatggtttattttcttagcccacattatgattttaggtgcaatactgaatgccagcgttcaagaaattgcgacaggaaaaattgaatcaaggcgtggagatattatgtctcttatccaaaaatccaaagaagaaaaataagaaaagacagctcttgttagagttgtctttttttgtctttaaaaataacaaatttgctcaagatgtagttgagtaaaataattaatatttgagatacaaggctttcaatggtgttgattttatttaaattgtgctgaacgaattgtccgataatagaaggaaattgatcaacaaaaataacagctaatatcaaatctaatcctaatgtgcctaatctagcgatgacaaatgtttgtaagcgttgaagctgttcaattttagtttgtttaaaaacaaatcgatcatttgtaaaaaaagcaaaaagtatagctattatgttagcaactattgcagagaatggagcgtcctgcgagaaattaaaaatcccttgtcgaataactaaataaagaagggatgttaatagtccgaacagtaaatataagctgacttcattttgaatactttttttcagtaacgattttaatttaaccatatttttattatatcacggatgcttcaaagtgatgaggaaatctcccataagcttggctttactttttgtttgtgatatacttagtaagttgttttacacaacccttgatgcttagttccctttcatcaagcatattacaaacgttagaagtgttaactatctaaacgttaaaggagaaattatgaacacatttacaactcgcgattacgctcacatggctattgtaacagctatctatatcgttttaaccataacgccaccttttaatgctattgcttatggtgcttatcaattccgtgtttcagaaatgctaaatttcttggccttttaccaccgaaaatacctttttgcggtaacgttaggatgtatgatttctaatctttatagttttggaatgattgatgtctttgtaggtggtggttcaaccttactttttgtttatcttggaaccattttattcaagcaatatcaaaaagattatctatttaatggccttattaacaaagcattctttttcttttctttcttctttgctgcttcaatgattacggtagcagttgaattgaaaattgtagcaggattacctttattattaacatggttaacgacagctgttggtgaattggcttcacttttggttggagcagtccttgtggataagttgagtagacacgtcgattttacaaaataaatatattataaagcgcgagacattgatctcggcttttttgtttgggtttatagttagcatagctagaaaatgctgcaacttttatgagaaatgctccaatttttactaatatccttagtctttgtgataaaatagaaatatggaaaatcgtatgaatgaattagtatctttgttgaatcagtacgcaaaagagtattatacacaagataatcccacagtttctgacagtcaatatgaccagttatatcgagagttagtagaattagaaaagcaacatccagaaaacattttgccaaatagtcccacacatcgagtgggtggtttagttttagaaggctttgaaaaataccaacatgaatatcctttgtattcattgcaggatgctttctcaaaagaagaattgatagcctttgataaacgtgttaaagcagagtttccaactgctgcttatatggcagagctgaaaattgatggtctatctgtctcgttgacttatgtaaatggtgttttacaggttggggcaacacgtggtgatggcaatattggagaaaatattactgaaaatttaaagcgtgttcatgatattcctctacatttagaccaaagtttagatattactgttcgcggagagtgctaccttcccaaagaatcttttgaagctattaacatagaaaaacgagcaaatggtgagcaggaatttgctaatcctaggaatgcagcagcaggaaccttgcgccaattaaacacaggaattgttgcgaaacgtaaattagcaacttttctttatcaagaagctagccctacgcaaaaagaaacacaagatgatgttttaaaagagctagaaagctatggcttttcagtcaatcatcatcgtttaattagctcgtctatggagaaaatttgggattttatccaaactatagaaaaagatagagtttccctcccttatgatatcgatggtattgttattaaggttaatagcatagcaatgcaagaagagctgggcttcactgtaaaggcacctcgttgggcgattgcatataaatttcctgctgaagaaaaggaagcagaaatattatctgttgattggacagttgggcgaacaggagtcgtaacaccaacagctaacctaactccagttcaactagcagggacaaccgttagtagggccactctgcataatgtagattatattgccgaaaaagatatccgtattggagatactgttgttgtatacaaagcaggggatatcatccctgcagtcttaaatgtcgttatgagtaagcgaaaccagcaagaagtcatgcttattcctaaactatgtccttcttgtggtagtgaattagttcattttgaaggtgaggtggctttacgttgtattaatccgctgtgccccaaccaaatcaaagaacgtttagctcattttgctagccgagatgctatgaatattacaggttttggtccatccttagtcgaaaaattatttgatgctcatttaatagcagatgttgcagatatttatcgtttaagtatagagaatttattaactttagatggtattaaagagaaatctgcaactaagatttatcatgcaatccaatcttcaaaagaaaattctgctgaaaaacttctttttggcctaggtattcgtcatgtgggaagcaaggcgagccgccttttattggaggaatttggtaatttgaggcaactaagtcaagcaagtcaagaaagtattgcctcaattgatggactaggaggggttattgccaaatcacttcataccttctttgaaaaagaagaggtagataaactactagaggaattaacttcctataacgttaattttaattatctaggaaaacgagttagtacagatgcacaactttcaggtttaacagtcgttttaaccggtaagcttgaaaaaatgactcgtaatgaagcaaaagagaaattacaaaaccttggtgctaaggtgacaggtagcgtttctaaaaagactgatttaattgttgcaggaagcgatgcaggaagtaaactaaccaaggctcaagatttagggattacaatacaagatgaagactggttactcaacctttaagtgaggaagaaatgaagaaacaaaaaaaagcgcgtttaatttataacccaacttctggtcaagaaattatgaaaaaaaatgtagcggaagttcttgatatacttgaaggatttgggtatgaaacatcagcctttcaaacaacaccaactaaaaattctgccagagatgaagctactagagctgctcaagctggttttgatttgattgttgcagcaggtggagatggtactattaatgaagttgttaatggtattgcacctttgaaacgtcgtcctaagatggcaattattccaactggaacaactaatgattttgctcgtgccttaaaaataccgcgaggtaatcctattgaagcaactaaattaattggtaaaaatcaaatcgttaagatggacattggtcaagctcaagaggacaattattttattaatattgcagctgcaggtagtttgacagagttaacttatagtgtaccaagtcaattgaaaacaacgtttggctatcttgcttatctagcaaagggtgttgaattattacctcgagttcgaaaagtaccagtcaaaattactcacgataagggtgaatttatcggtgatgcttcaatgatttttgttgccatcacaaattctgtaggagggtttgaacaaattgcacctgatgccaaattggatgatgggaaatttacccttattttagtaaaaactgcaaatcttattgagattatgcatctcattcgtttggtgctagcaggtggaaaacatattaatgataaacgagtagagtatattaaaacgtcttatctaactatcgaacccctatcagacgagcgtatgatgattaacttagatggagaatatggaggagatgctcccattactctagcaaaccttaaaaatcatattaggttctttgctaatactgatgaaatttcagatgatgctttagttttagataaagatgaactagcgatagaagctattgcacagaagtttgctaatgaggtagatgatttagaaggattaggagattgatgaatggataatactgtcattgtacattaccatagccgaaagaaaaattactttaatttaagtttatggcagtggcgcgatggctcagagggtcaagatgctcatttttcacggtttgacagtttcggtgctgttgcgatactaaaatatcccttgccatattttttaagccattattatgtgattgttaaggataaaaattggcatcataaaacaatagattatcgcattgattgtactcaaggtggtgcacgtaaagaagtttggattgtagatggggatgacaatctgtattattctcgtcaagcagcagttagtagccatcattatagtagacgccaacctcatgcctacgacatggcaatcaatagtagagcgtttgacaaaaaatggggatttgatggttggttaggttttgaatattcagaaactaaaacggcttttagattatgggcccctactgcggaacgtgtagaactgattttatatcattcgacagatgaaacagcaagtgtatcaaaagttctttctatgaaaagagggacagccgtcaattataaaaatcataaagaaaatacccatggagtctggtttactgaacttgaaggaaactataattaccaagcatatacttatcgagtctactatagacgacgtacctttaaaattacgagagacccttattccattgcaacgactgcaaatggtaaaaggtctattgttattgctccagaagcattaactccggaagggtttaaaataagtcatggaaaagaagctaagtggcggctcgaaaaccccaatcaagcagtcatttacgaaatgcatgtgcgtgatttttcgatatctgagacttcaggagttaagacagattatcacggaaaatttaagggattgcatcaaaaaggtacggttaatcagcatggtgataaaacgacctttgattatgtacaagacctaggagttaactatatccaacttcaaccaattttcgatcatcatcagacatttgatgatgatggtcactatgcttataattggggatatgatcctgaaaactacaatgttccagaagcaagcttctctagtaatccacatgaacctgcaacgcgtattttagaattaaaatctgctatccaagcgtaccatgatgcaggcattggtgttattatggatgttgtctataatcatactttttcatcaactgattctgcatttcaactaacggttccagattattattatcgaatgaatcacaatggaacatttcaaaatgggtcaggctgtggtaatgaaacagctagtgaaaaagaaatgtgtcgtaagtatattcttgattcagttttgtattgggtgaaagaatataatattgatggttttcgatttgatttgatgggactacatgatgtagaaacgatgaacattataagaaatgagctaaataaaatcgaccctcgtattttggtttatggagaaggatgggacatgggagctggtctcacgcctcaaaataaagctaaaaaagataatgcttatcagatgcctggaattggctttttcaatgatgatgtaagagacgctgtcaaaggtgcggaaatttacggagaatttaaaaaaggcttagtttctggaaacagtacagaagatattgttgcaaaaggcattttaggaagtgatgagttagtatcatacattgatcctagtcaagttttaaattatgttgaagcacatgacaactacaacttaaatgatttgctatgggaattacatcctaatgacaacgagaaacaacatatttaccgagttgaagtagctagtgctatgaatctattgatgcaagggatggctttcatgcaattaggtcaggagtttcttcgaacaaagtgttatcctacaggtgataaaggtcaacttactcaagcagataaagaaagggctatgaattcttacaatgccccagaccaagttaatcaggtcaactgggataatgttacctttcataagagtactattaattttattaggaaaataattactttgaagacaaactctccttacttttcttattctagctttgaagagattcgcaaacatgtttttgtagagtctgctcaataccattcaggtttcataagttttacagtcgaagaacataagaaaataaaaataattttcaatattaaaggaaaacgcttgcagaattctttcataggtgatataataatatcaaatcatgaagaaggaaaagcgatagattcattagatgatgagctttctgtaatgatccttgatatcacaaaataacctgaaaacattcaggttatttttgtgtatattaaggaatttgatttgaatttgagtttcttatattttagttaatttttcggaaatatagagggtgaaatattttcagatgcgtctgtatgaggaaaatgtattcctctttttttgtaccattgaggaaatatttttgtcttatattgactagtaggacctgtgaggtgagtagatgtccaataaagatgagttatatacttttggaataggtgaaaattttcatctccagaattatttaggcgtacatagcgaaaatggaagcttttgtttcagagtttgggctcctaatgctgaaaatgttcaagttattggagattttacagattggcgaaatcgacctctccaaatgaacaaaaatcaagcaggagtttgggaagctaacagtttggatgcgcgcgaaggtgatttatataaatatttggttactcgtaaaggtggtcaagtagttgagaaaatcgatcctatggcagtttatatggaaagacgtcctggaactgcaagtgttattaaagttcttagaaataaaaagtgggaagatggtctttggatgggaaggcgcaaacgtctgggttttcagaagcgtccaattaatatttacgaagttcatgctggttcatggaaaaaagatgattttggacatcctatgactttttctcagttaaaagattacttaatcccctaccttgttgagatgaattatactcatgttgaatttatgcccttaatggcacatccgcttgatatgagttggggatatcaattaatggggtattttgcttttgaacatacctatggtactccagaagaatttcaagactttgtagaagcatgtcataaaaataatataggagttcttgtagattgggttccaggacactttattcagaatgacgatgctttagcctatttcgatggaactgctacttatgagtatcaaaatcatgatcgtgcgcataactatcgatggggagctctgaactttgatttaggaaaaaatcaagtacaatcctttttgatttcgagtgccttgttctggattgaacattatcatattgatggtattcgtgttgatgcggttagtaatatgttatatctcgattatgatgaaggaccatgggaagctaaccaatttggggataatcgtaatttggaaggatatcactttttaaggaaacttaacaaagtaattaaagagcgtcatcctaatgttatgatgattgctgaagagtcaacagcttctaccccaataactaaagacttagagtctggaggattgggttttgactttaaatggaatatgggctggatgaatgatatcctgcgtttttatgaagaagatcctctctataggcaatatgattttaatttagtgacttttagttttatgtatatattcaatgagaactttgtactagctttttcacatgatgaagtagtacatggtaaaaagagtatgatgcataaaatgtggggtgaccgttataatcaatttgctggtttacgtaatttatatgcatatcaaatgtgtcatcctgggaaaaaacttctctttatgggaagtgagtttggtcaatttttagaatggaaatataatgatcaactagaatgggaaaacttaaatgatgatatgaaccaaaagatgcaacgctatactaaacaattgaatcaattttataaagatcataagtgcctatggcgtattgatgattcctttgacgggctagaaattattgatgcggataataaatctgaaactgttttatcttttatacgaaaagatgataaaggcgatttgttactttgtgtctttaatatgactcctgtagaacgccctaactttactattggtgttccgcaagcgggtatttatgaagaagttttaaatactgaaatggaagagtttggaggtgtttggaaaaaccacaatcctgtaacgaaaacacaagtggctacatggaaagattatgatcatactttaagttttacattaccagcccttggggcaagtgtttggagaataaaacgtcggcttcgtaaataagtctgcaatttagtaacctcattttgaaaggaaagaataatatgaaaaatgaaatgttagcactcattctcgccggaggacaaggcactcgactcggaaaattgactcagagcattgcgaaacctgctgttcaatttggaggtcgttaccgtattattgactttgcgctttcaaattgtgcgaattcaggtattaataatgttggagttattactcagtatcaaccgctggaactcaatactcatattggaaacggatctagctggggactagatggtatcgattcgggagtaactgtattacagccatattctgcaacagaaggtaatcgctggtttcaaggtaccagccacgctatctatcaaaatattgactacattgatcgtattaatccagaatatgtactcattctctctggggaccacatctataaaatgaactatgatgacatgctacagacgcataaagataatttagcaagcctaacagtcgctgttttagatgttcctttaaaagaagcaagccgttttggaattatgaatactgattcaaacgaccgtattgtcgaatttgaagaaaaacctgaacatcctaagtcaacaaaggcttcaatgggaatatacatttttgactggaagagattacggacagttttaattgatggtgaaaagaacggcatagacatgtcagactttggtaaaaatgttataccagcataccttgaatcgggtgaacgtgtttatacctataattttgatgggtattggaaagatgttggtactattgaatccctttgggaagctaatatggaatatattggagaagataacaaattacatagtcgtgatcgttcatggaaaatctattctaaaaatttgattgcaccacctaatttcatgacagaagatgcaaatgttaaagattctttagttgtagatggatgctttgttgcaggaaatgttgagcactccattttatcaactaatgtccaggtaaaaccaaatgctattattaaagactcctttgttatgagtggcgcgactatcggtgaaggtgcaaagataaatcgagctattatcggtgaggatgctgttattggtgatggtgttgtgattgatggaagtaaagaagtagaagttattggttataaagaagtagcgggggttccaaatgaagattgataaatatactgcgattttaggaaatactgttagttacccagatatgcacagtttgacggataatcgtccgcttgcttctctaccttttgatggtaagtatcgtttaattgattttcaattatcctctttagctaatgcaggcgttagaagtatttatggtatttttcgtgggaataatgttcgctctgtttttgaccatattagaagtggtcgtgagtggggcttaggtacactgttgagtcactattctttaggattctatgatacagacgatgatactcgtacagtcaatggggattattacgatcaaattttaacttacttgaggcgttcgggtagcgaccagacgatatatatgagttgtgatatgctttgtaatattgacttaagtcaagtaatccacttgcataatgcaaatggtgcgcaagccaccgtggtttaaaaaaaatgccgagatcagctattgcagaggctaatcaagtcttgaccattgatgaatctgatcatgtagtgagtctaggtaaagctgtagataatgacgataaccaaaaaatgtctgctgagatttatgttatcgatacaccttggttaatcgaaaaaatggaagaggaagctcaaaataatgaaccacgtaaactccgcttcttacttcgtgatttaattgttgaaagtaatgctttggcttttgaatacactggttatttgtcaaacatttcttctattaaatcctattatgatgctaacatggacatgttaacaccaaataaattttattcgctcttcttttcaaaccaaaaagtttatactaaggtgaaaaatgaggaagctacttattttgataaacaatcaaatgtctctaattcgcaactagcctctggaagtattattaaaggttatttagaccattctatcgtttctagaaattgtctccttgaaaaagggactcgagtagtcaatagtattatctttccaaaagtaaaaatcggagaaggggcaaccattgaaaatactattattgacaaatgcgttaaggttgcatccggagttacattgaaaggtagtttagataaaccgttagtgattcctaaattttcagagattaatgaggatattatacaatgaaaataatgtttgttgcggcagagggtgctccctttgctaaaacaggtggtttgggagatgtgattggcgcactcccaaaatcacttagtaaaaaaggtcatgatgtcgctgttgtcatgccatattatgatatggtagaccaaaaatttggagaccaaatagaaaacctcatgtatttctatacagatgttggctggcgtcatcaatatgtaggagttaagagactttctcaagataatgttacgttctactttattgataatcaatattatttttatagaggtcatgtctatggtgattgggatgatggggagcgttttgcttatttccaattagctgctttagagttgatggagaaaatcgattttattcccgatgtcttacacgtccatgattatcatacagcaatgattcctttcttattgaaagagaagtaccactggattcaggcctataataatataagagcagtttttactattcacaatattgaatttcaagggcagtttggtccagaaatgttaggagatttatttggagttggcgctgagagatatgaagatggaactcttagatggaataattgtcttaattggatgaaagcagcaattctttactcagatagagtgacaacggtatcaccaagctacgcaaatgaaataaaaactccagaatttggtaaaggtttagatcaaattatgcgtatggaagcaggcaaattatctggaattgtaaatggtattgatagcgatttgttaaatccagaaacagatgcttttttgccatatcatttttcaaaaagcaacttagagggcaaaattaaaaataagttggctttacaggaaaatttgggcttacctcaagataaaaatgtaccattaattggtattgtttcacgacttaccgatcaaaaaggatttgatattattgcttctgaattggacaatatgcttcaacaagatattcaaatggttattttaggaacaggctatcaccattttgaagaaacgttctcttattttgctagtcgttaccctgaaaaactatctgctaatattacttttgacttaagattagcgcaacagatttatgcggcttcagatatcttcatgatgccaagtgcttttgaaccttgtggtctctcgcagatgatggctatgagatatggtagcttgcccttggtacatgaagttggaggattaaaagatactgtggtagccttcaatcaatttgatggtagtggtacaggtttttcatttaatcatttttcaggctattggttaatgcaaactctaaaactagcattagaagtttataatgattatcctgaagcgtggaaaaagttacaatggcaagctatgtcaaaagatttttcatgggatacagcatgtgttgcttacgaacaactgtatcagcaactacaataatcaccctattttagtgattagttgataagcttatcgaatctctatgctaaacgtttcttatgtaaaaccactttagtatagagattttattatcctataaggtaaaatattattaatgtaaagagacactatatcaaaaataaagtgttgtcatatcttaataagggattaaattaaagctaaaaaaactaaaaattgttatttgaaaaggattgtgtaaaccatctcaaactatttcatgaaaacgtaatcaaatgaggaaattcattgacatgcacaagaaataggaataaaataacggagtaaatattttttaaaggagaattctattatgaatttagctattttagcacttggtttcgccgtgatgggtgtttcaatcggtgaaggaattttggttgcaaatattgccaaatcagcggctcgtcagcctgaaatgtttagcaaactgcaaacattgatgtttacaggtgtggccttcattgaaggtaccttcttcgttctatttgcgtttacattcttagtaagatagacgacaatttagaaaaaaaggagggatgaggattggaatctacaagtaatccaaccgtatcttttttaggcattgattttgatttaaccatcctagctatgtctctcttgacaattactattatctttatcttagtcttctgggctagtcgtaagatgacaataaaaccaaaaggtaagcagaatgtcttagaatatgtctatgagcttgttaataatacaatctcacaaaatttaggacactatactaaaaattatagtttattgatgtttattttattcagttttgtcttcattgctaacaacttaggattgatgacatcattgaaaacacatgagcataatttttggacatctccgaccgctaattttggtgtagatattacattatcattattagtagcatttatttgtcatattgaaggtattcgcaaaaaaggaattggtggttatctcaaaggtttcttatcaccaacaccagcaatgcttccgatgaatttattggaagaagttactaatgttgcttcattagcattgcgtctttttggtaatatcttttctggtgaagttgtcactggattacttttacaacttgcagttttatcaccatttacaggtccactagcttttgcattgaatatcgtttggacagcattctcaatgtttattggtttcatccaagcgtatgtgttcattatcttgagctcaagttatattggacacaaagttcatggtgacgaagaagaataagaaaagagaggagaaatatgtcaatacttattaatagtacaacgattggtgatatcattatcgtatctggctctgtgcttctcttatttatcttaattaagacttttgcatggaaacaaatcacaggtatttttgaagcccgtgaacaaaagatagctaatgatattgatactgctgaacaggcacgtcaacaagctgaagcttttgcaactaagcgcgaggaagaactatctaacgctaaaactgaagctaatcaaatcattgataacgctaaagagacaggtcttgcaaaaggtgatcaaattatttcagaagcaaaaactgaagctgatcgattaaaagaaaaagcacatcaagatattgcccaaaataaggcagaagcactagcagatgttaagggtgaagtagcagatttaacagttttattagctgaaaaaattatggtatcaaatcttgataaagaagctcagagtaatctcattgatagctatattaaaaagctaggagatgcctaatgaataaaaagacgcaggctctaattgagcaatattcaaaaagccttgttgaagttgccattgaacataaaattgttgaaaaaatccaacaagaagtagcagctttaattgatatttttgaaacaagcgagcttgagggtgtcctgtcaagtcttgccgtttcacatgatgaaaaacaacattttgtgaagacattgcaaacatcatgttcaacttatcttgttaatttccttgaggttattgtacaaaatgaacgtgaagcacttctatatcctattttgaaatcagttgatcaggaacttatcaaagtgaatggtcaatatccaattcaaattacaactgcagttgctttgtctccagaacaaaaagaacgtctttttgatattgctaaaactaaattagctttaccaaatggacagttagttgagcacattgacccatctattgttggtggatttgttgtcaatgcaaacaataaagtaattgatgcaagtgttcgtaatcaattacatcaatttaaaatgaaattaaaatagaaagtggtgtgacttttggcaattaatgcacaagaaattagcgctttaattaaaaagcaaattgaagacttccagccaaattttgacgtcacagaaactggtattgttacatatatcggtgatggtattgctcgtgctcgtgggctagataatgctatgagtggagaacttcttgaattttcaaatggtgcgtacggtatggctcaaaaccttgagtctaatgacgtgggtatcattattttgggtgatttctcagaaattcgtgaaggtgatgtggtaaaacgtactggtaaaattatggaagtaccagtaggggaagctatgattggacgtgtcgtcaatccgcttggtcaaccagttgatggactaggtgaaattgagacgacagcaacacgcccagttgaaacaccagcacctggtgttatgcaacgtaaatcagtttttgagcctcttcaaacaggtctcaaagcgattgatgctttggttcctatcggacgtggtcaacgcgaattgattatcggtgaccgccaaactggtaagacgtctgtagcgattgatgcaatcttgaatcaaaaaggtcaagatatgatctgtatctatgtggctatcggtcaaaaagagtctacagtacgtacacaagttgaaactttgcgtaaatacggtgcccttgattatacaatcgttgtgacagcttcagcatcacaaccatctccattacttttcattgctccatatgcaggagtagcaatggctgaggaattcatgtataacgggaaacacgttttgattgtttatgatgatttatcaaaacaagccgtagcttatcgtgaactttcgcttcttcttcgccgtcctccaggtcgcgaagcttacccaggggatgttttctaccttcatagtcgtcttttggaacgttcagctaaagtatcagatgctttaggtggaggttcgattacagcgcttccgttcattgaaacacaagcaggtgatatctcagcatatattgctacaaacgttatttcaattactgacggccaaattttcttgcaagaaaatctctttaactcaggtattcgtccagcgattgatgcaggttcatcagtatctcgtgttggtggtgcagcgcaaattaaagcgatgaagagagttgcaggtacgcttcgtctagatcttgcttcttatcgcgaacttgaggcattcactcaatttggttcagaccttgatgcagcaacacaagcaaaactaaatcgtggtcgtcgcacagtggaagtgttaaaacaaccattacacaaaccattaccagttgagaaacaagttgtgattttatatgctctaacacatggattccttgatgatgtacctgtaaatgatattttagcttttgaagaagctttgtatgattactttgatgctcattatgataatctcttcgaaacaatccgcacaacaaaagatttaccagaagaagcagaattagatgctgctattcaagcatttaaagatcaatcacaatttaaataataggagggttctaatatggcaggctctcttagtgaaattaaagacaagattctctctacagaaaaaacaagtaagattactagtgcgatgcagatggtctcatctgctaagttggttaaatctgaacaagctgctagagattttcaagtgtatgcctctaaaattcgtcaaattactactaacctcttaaagtcagacttagtatctggatcagataaccctatgttatcttcacgtccggtgaagaaaacaggttatattgttattacttctgataagggtttagttggtggttacaattcaaaaatcttaaaagcgatgatggacactataactgactatcatactgagaatgatgattatgccatcatttcaattggtagtgttggttctgattttttcaaagcacgtggaatgaatgtttctttcgaattacgtggtttagaggaccaaccaagttttgatcaagttggtaaaattattgctcaagcagttgaaatgtacaaaaatgagttgttcgatgaattatatgtttgctacaatcaccatgttaacagtttaactagccaagtcagaatgcaacaaatgcttcctatcaaagaattggatgcagaagaggcttctgaggatagagtgattactggttttgaacttgagccaaaccgtgaagttatattggagcaattattgcctcaatatactgagagtttgatttatggagctattattgatgctaaaacagcagagcatgcggctggtatgacagctatgcagactgcaactgataatgctaaaaatgttatcaatgatttaactattcaatataaccgcgctcgtcaagcagctatcacacaggaaattacagaaattgttgcaggtgctaatgcacttgaataattaattagtctatagaaaaaatagtgaacaaaggtattttaaatcctttgtatcatatgataaggagaaatacatgagctcaggcaaaattgctcaggtagttggacctgtcgttgacgttgtatttgcaagtggcgacaaacttcctgagattaataatgcattgattgtctataaaaatggcgataagtcacaaaaagtagtacttgaagttgctcttgaacttggtgacggcctcgttcgtacaatcgctatggaatcaactgatgggcttacacgtggtttggaagtattagatactggtcgcgcaattagtgtgccggttggtaaggatactttgggtcgtgtcttcaacgttcttggagatgctattgaccttgaagagccttttgcagaagatgcagaacgtcaaccaatccataaaaaagcaccatcgtttgatgaattatcaacatcatcagaaatcttagaaactggtattaaagttattgacttattagcaccttacttaaaaggtggtaaagttggacttttcggtggtgcaggtgttggtaaaaccgttcttattcaagaattaatccacaacatcgcccaagaacatggtggtatttcagtatttactggtgtaggagaacgtactcgtgaagggaatgacctttattgggaaatgaaagaatctggcgttattgaaaaaacggctatggtctttggtcaaatgaatgaaccaccaggagcacgtatgcgtgtggcacttactggtcttacaatagctgagtacttccgtgatgtagaaggacaagatgtgcttctcttcattgataatatcttccgtttcacacaagctgggtcagaagtgtcagcgcttttaggtcgtatgccttcagccgttggttatcaaccaacacttgctacagaaatgggacaattacaagagcgtatcacttcaactaaaaaaggttctgttacatcaatccaagctatttatgtgccagcagatgactatactgaccctgcgccagctacagcctttgctcacttagattcaacaactaaccttgaacgtaaattgacacaaatggggatttatccagccgttgacccattagcttcaagttctcgtgcactcacaccagaaatcgttggagatgagcactatgaagttgcaacagaagtacagcgtgttcttcaacgttaccgtgagttacaagatatcattgcgattttaggtatggatgaattatcagatgaggaaaaaacgttagttggacgtgcacgtcgtatccaattcttcctttctcaaaacttcaatgttgcagaaacatttactggtcaaccaggttcatatgttccggttgaagaaactgttcgcggattcaaagaaatcctagatggtaaacatgatcaaattccagaagatgccttccgtatggttggtggtattgaggatgttatcgcaaaagcagaaaaaatgaactattaatgaggtgatgctatggcacaattgactgttcaagtagtaacaccagatggtattagatatgaccatcacgctagtctcattactgttagaacgccagatggtgaaatgggaattttaccaggtcacataaatttgattgctccccttaatgttcatcagatgaagattaatcgttctcatcaagaaggtgtagactgggtagctgttaatggtggtataattgaagttaatgaggatcaggtgacaattgttgcggattcagcagaacgagcacgtgatatagaccttaaccgtgcagaacgggctaaggaacgcgctgagcgtgcattagaaaaagctcaaacaactcagaatattgatgagatgcgtagagctgaggttgctcttcgtcgcgcaattaaccgtattagcgtcggtaaaaagtagaaaaatggtctaattagttttgtgactaattaggcttttttagtgtataatagaaggcatgaatatgatattaaatatagtaactatagttagtaattttatttttattgcccttttttatcaactttttgtagatttatttgactggtctaaaatgattaaaatgtcccctcaaaacatctcaaaattaaaagtttttattttgttgataagtatagttggtggctatgtggttagtcattttttattggaagtgattcagttgtgtcaatcaatcttttgggctctccaataaaggaaatattagctgaactatgatataatcaacttactattgttataagaatggagattcaaatggataaaattattgtggaaggtgggcaaacgcagcttcaaggtcaagttgttattgaaggagctaaaaatgcagttttacctcttttagcagccacaattttaccaagccaagggaaaacattgttgaccaatgttcctatcttgtctgatgtatttacaatgaacaatgttgttcgtggtttagatattcaagttgactttaattgcgataaaaaagaaatcttagtggatgcctcaggtgatattttagatgttgcaccttatgaatttgttagtcaaatgagagcttctattgttgttttgggacctattttagctagaaatggccatgctaaggtttcaatgccaggcggttgtacaattggtagccgaccaattgaccttcatcttaaaggtttagaagctatgggagctacgattacacaaaatggtggtgatattactgcccaagctgaaaagcttaagggagctaatatatacatggattttccctcagtcggtgccactcaaaacttaatgatggctgctacacttgcttcaggcacaacaacgatagagaatgctgcacgtgaaccagaaattgtagaccttgcgcagttactaaataaaatgggagctaaagtaaagggtgctggtacggaaacattaacgatcattggtgttgatgctttacatggtacagaacatgatgttgtccaagatcgtattgaagctggaacctttatggtggcagctgctatgacttctggaaatgttctagtaaaggatgctatttgggaacataaccgtcctttaatctctaaattgatggagatgggtgttgaagtgtcagaggaagaagatggtattcgtgtaaaagctgatactaaaaaattgaagccagtgactgtgaaaacactccctcatccaggatttcctactgatatgcaagctcaatttacagctctaatggcagtagttaatggcgaatcaactatgattgagacagtttttgaaaatcgttttcaacatttggaagaaatgcgtcgcatgggattacaaacggaaattttacgagatactgcaatgattcatggtgggagagctttacaaggtgcaccggtcatgtctactgacttacgagctagtgcagctttaatcttggcaggaatggttgcgcaagggcaaacagtagttggccaattaacccatttagaccgtggttattatcaattccatgaaaaattagcggctcttggtgctaatattaaacgtgtaagtgaggcgtaatatggcatctagtggttggaaatatgtattaaaacaaatcggtctaatagtattagtcatactattagccttgctgtttttagcggttggattgatgttgggttatagtgtttttggtgacggagagcatgcttactctattttatcgctggataaatggcaaaatattattggaaaatttttaggaaaatagaaagagccactataagttatttgatgcttatagtggtttcctttgagagttaattttagcagtagaataatacaatgacaaaaaaacaaaaacaaataacagcttcgattgtaactttgcttttttcattactggcaatagggttaggtgaaagcaaatctttgcctaatgatcacattttaaaacaggtgacagatttaattattagtaatgaatctggcaaaaatacttcccttaaaaatgtatcaggaactcctagtagagagttatctgaatctgttttgactagcaatgttaaaaaacaattgggaacaaatatagcttggaaccagtcaggtgcttttatcattaatcaaaataaaacagatttgaatgctaaagtgtcaagtgcaccatatgctattaatgaaataaagaaggttaataaccaaattgttccgactaaagcaaatgccttattaacaaaagcaactcgtcaatatcgaaatcgagaagaaacagggaatggtagaacttattggaaaccagctggatggcatcagataaatggattaaaagggagctataaccacgctgtggacagaggccatttaattggttatgctttagtagggagtttaagaggatttgatgcctccacaagtaatcctaaaaatattgccacacaagcagcttgggcaaaccaagctaatagcaaccaatcaacagggcaaaattattatgaaactttagttcgtaaagcattggatcgtcataaaactgttaggtatcgtgtgactttaatttatgacagagataatcttttatcttcgggatcacatattgaggctaaatcttcagatggaagtttagaatttaacgtttttattcctaatgtacaatcgggattattatttgattatgcaacaggaaaagtgaagcagacaaagtaatctttatctaatagtgcttgttaaagactgaaaaatttgataaaatagtctttaattgaatagaggtctgtgagactagtaaaccaagggaagctgcttagggagttcagccgtgactgcaagctgaatcagtgaaagagggtggaattcactcacaaataggactataattaaggtctgattggtcgatcagatagaaaacggatggtaccgcgtgtcaacgctccgattaaggggtagtggcacgcttttttttgttttcaaagctacttattttgacttggaggaaagatggatttacaaaaacaattagaagagttgaaaatatcaactcaagaaaagcttaaagaaatgactgggaaccacactaaagaattacaagacttacgtgtacaagttttaggaaaaaaaggttctctaacagaattactaaaaggtctgaaagatttatctaatgatttacgaccagttgttggaaaacaagtcaatgaagtacgtgatattttaacaaaagcgtttgaggaacaagctaaagtagtggaagctgcgaagattcaagcacagttagagtctgagagtgtcgacgttaccttgcctggtcgtcaaatgacattaggtcaccgtcatgtcttaacacaaactagcgaagagattgaagatatctttttaggtatgggattccaagtggttgatggttttgaagttgagaaagactactataattttgaacgaatgaatttaccaaaagatcatccagcccgtgatatgcaagatactttttatattacagaagaaatcttgctacgtactcatacttcgcctgttcaagcacgaacaatggaccaacatgatttttctaaagggcctttaaaaatgatttctcctggacgtgttttccgtcgtgatactgatgatgctactcatagccatcaattccatcaaattgaaggcttagttgttggagaaaatatttcaatgggcgatctcaaaggaacacttcaactgatttctcaaaaaatgtttggagcagagcgtaaaatccgacttcgtccttcatatttcccattcacagaaccttcagttgaagttgatgtctcttgcttcaagtgcggaggtaagggatgtaatgtctgcaaacagacaggttggattgagatattgggtgctggtatggttcacccaagtgttttggaaatgtctggtattgattctgagaaatactccggttttgcctttggtttaggtcaagaacgtattgcaatgttacgctacggtatcaatgacattcgtggcttctatcaaggtgatgttcgcttcacagatcaattttaagattttagatagcaagtagcatcattggtgtgatgataaatttatgttaacgctattaccttactcaataggaggttttctaatgtctcaaattacttttaaaaaggttggccttgataatgtgaatattttacagaatattgctatagaaacctttcggcagacgttttctcatgataatagtgaggaacaacttcaagcatttttcaatgagtcttacactttaccagtattaaaatcggaaattacccatgctgaatctgatacttattttgtttatcttgatacagatttagtgggttatttaaaagtaaactggggaagtcagcaaactgaaaaagatcttgataaagcatttgaaattcaaaggatttatcttctagatgcctaccaagggcaaggtataggtaaggctactttcgaatttgctttggatttagcttataaatcaggcttagattgggcttggttaggtgtttgggagtttaatcataaagctcaggcattttacgctaaatacggatttgaaaaattttctgagcaccaattttcagtaggtgataaagtggatacggattggttattaagaaaaagtttacactaaaaactacaaagcacttgtataaaaataaaagaaaataaatagagagaaattacatgttagtatcgtataaatggttaaaagagttagtggatgttgatgttacaacagcagaactagctgagaaaatgtcaaccactggtattgaggttgaaggtgtggagacaccagcggaaggtttatcaaaattagttgtaggtcatattgtttcgtgtgaagatgttccagatacccacttacatttgtgtcaagttgatacaggggatgatgaacttcgtcaagttgtctgtggtgctccaaatgtcaagactggtattaatgttatcgtagcggttcctggtgctcgtattgcagataactataagattaaaaaaggtaaaatccgtggtatggagtcacttggaatgatttgttcacttcaagagttgggcttatcggaaagtatcattccaaaagagttttctgatggtatccaaattttacctgagggagctatacctggtgatagtattttctcttatcttgacttagatgatgaaattattgaattatcaattacaccaaaccgtgcagatgctctttcaatgcgtggtgttgcccatgaggtagcagcaatttatgggaaaaaagttcattttgaagaaaaaaatctcattgaagaagcagaaagagcagctgataagatttctgttgtcattgaatcagataaagttttatcttactcggctcgtattgttaagaatgtaacagttgcaccaagtccacaatggcttcaaaataaactgatgaatgctggtatacgtccaattaataatgttgttgatgtgacaaactatgttcttttgacttatggtcaaccaatgcatgcttttgattttgataaatttgatgggacaactatagtagcacgtaatgctgagaatggggaaaagttaattactcttgatggtgaagagcgtgacttaatagctgatgacttggtcattgcggtaaatgatcaaccagttgctttggcaggcgttatgggaggacaatcaactgaaattggtagttcttctaagacagtggtccttgaagcggcagtatttaatggaacaagtatccgcaaaacaagtggaagactcaaccttcgttcagaatcatcttctcgctttgaaaaaggtatcaattatgatacagtttcagaggctatggattttgcggctgcaatgttacaagaattggcaggtggtcaagttctttctggtcaagttacagaaggagttcttccaactgagccggtagaggtatcaacgactcttggttacgttaatactcgtttgggaacagaacttacctatactgatattgaagaagtatttgaaaaactcggctttgctatttctggttcagaagtgaaatttactgtgttggtaccgcgtcgtagatgggatattgccattcaagctgacttagttgaagagattgcccgtatttatggttacgaaaaattaccaacaacattgccagaagccggagcgactgcaggagaattaacgagtatgcaacgcttacgtcgtagagtccgtacggttgctgaaggagcaggattatctgaaattatcacctatgctttaacaactccagaaaaagcagtgcagttctcaactcaagcaactaatataactgaacttatgtggccgatgactgttgatcgctcagcacttcgccaaaatgttgtttcaggaatgcttgatacaattgcttataacgttgctcgcaaaaacagtaaccttgcagtttatgagataggaaaagtttttgaacaaactggtaatccaaaagaagatttaccaactgaagtagagacgtttacttttgccttaacaggtctagtagaggaaaaagatttccaaacaaaatccaagccagttgatttcttctacgccaaaggtattgtagaggcgctctttattaaattaaaattagatgttacttttgtagcacaaaaaggtttagcaagtatgcacccaggtcgtacagcaactatcttattagatgggaaagagattggttttgttggtcaagtacacccacaaactgcaaaacaatatgatattcctgaaacttatgttgctgaaatcaatctatcaactattgaaagtcaaatgaaccaagcgttgatttttgaagatattacgaagtatccgtctgtatctcgcgatattgcattattacttgcagaatctgttagtcatcatgatattgtgtcagcaattgagacatcaggggtaaaacgtctaacagcgattaaactgtttgatgtctacgctggaaataatattgcagaagggtataaatcaatggcttatagcttaactttccaaaaccctaatgacaatctaacggacgaagaagtggctaaatatatggaaaaaatcactaaatcactcgttgagaaagttaatgcagaaataagataatttatattttacgttgaaaaataaataaaaaacagcatcaattaagatgctgtttttttatttaaaatttatagatgttctacggagaaagtatcaccgtgttggatgtcaccatattgaaagcctttgttaaaccaacgttggcgttgttcagctgttccatgggtaaagctatcaggcactaattttccgtaggtttctttctgaagggtatcgtctccgacggcgtgggcagcattcatggcctcttcaaagtctccttgttctaagagattttttcccctgatgtagtgagcccatacccctgcataataatctgcttgaagttctagccgaacatttaaagcatttgcttctttcttagtaagtccgtgtcgcattctattatacttatccataatgcctaactctgtttgaatgtggtgaccaacttcgtgggcgatgacgtaggccatagcaaaatcaccagtagcaccatatttatgtgataattcattgtaaaaagaaatatcaagatagatttttttatctgctgaacaataaaatggtcctgaagcagattcacctataccacaacctgtttgaattgaattggtgtaaagaacaagttttggttccttataatttccaaaaccttgggtttggaattcttgtgaccagaaatcctcagttgagccaaggactttattaacgaaatcgatttgttctctcgttgcgctattatcaacagaacgtgagacattctgagattggtaactagaaggtgaggatgagtcattaaaaatgctggttagtccccctccgccaagtagcagtaagatgattaaaaccacaagcttggttttccaactccctcgcagcaataaaagttgaagaatcggtaatccacttcctccgctagagaatgaacctccgctactggagcgacgatcttcaacattgtcgctttttcttaggtcatctattttcataagtatctccaaagtgttttataggctcattataaactattttaataagaaatgcttgaatttttaactaaatatcttcccctagatttgaagctatttttggtataatattaataaactgtaaaggataagttgaagaaggtttacttctcagttgacttataagataggagattcatgaaattactttatactgatattaatcatgatatgacagaaatcttagtcaatcaggccgcgcatgctgctgaagctggatggcgtattttttatattgctccaaactctttatcttttgaaaaagagcgtgcagtattagagaaccttcctcaagaagcctcttttgctattacaattactcgctttgctcaattggcacgttattttactttaaaccagcctaatcaaaaagaaagtttaaacgatattggattagcaatgatcttttatcgtgctttagcaagttttgaagatggacaattaaaagtttttggacgattgaagcaagatgcttcctttatcagtcaattggtagacctatacaaagaattgcagacagcaaatctgagtattttagagttaaaatatttacattctcctgaaaaatttgaagatttattagctatttttctagtggtttcagatcttttaagagaaggagaatacgacaatcaatctaaaattgccttttttacagaacaagtaaggtcaggccagctagatgtggatttaaagaacactatccttatagtcgatggttttacccgtttctcagctgaagaagaagctttaattaaaagtctgagttcacgttgtcaagagattatcatcggagcttatgctagccaaaaagcgtataaggctaactttactaatggaaatatttattctgcaggggttgattttttaagatatctagcaacgacatttcaaacaaaaccagaatttatcttgtccaagtgggaaagtaaatctggttttgaaatgatttcgaaaaatatcgaaggtaaacatgattttacaaatagtagtcacattttagacgacactgctaaagattgtataacaatttgggagtgcattaatcaaaaagatgaagtggaacatgtggctagagctatacgtcagaaactttatcaaggatatcgctacaaagatattttagttttactaggagatgtagatagttataaactacaattaagtaagatttttgagcagtatgatattccttattatttcggtaaagctgaaacaatggctgcgcaccctttagttcattttatggattccttgtctcgaataaaacgttatcgatttagagctgaagatgttttaaatctttttaagacaggtatttatggagagattagccaagatgatttagattattttgaggcttatatctcatatgcagacattaaaggtcctaagaagttctttacagattttgttgtgggggctaaaaaatttgatttagggcgtcttaacactattcgtcagtccctccttactccactggaaagttttgtgaaaacgaaaaaacaagacggtataaaaacactcaaccaattcatgtttttccttactcaggtaggtttgagtgacaatttatcgcgattagttggtcaaatgtctgaaaatgaacaagaaaaacatcaagaagtttggaaaacatttacagatattttagagcagtttcaaacaatatttggtcaagaaaaattaaatttagacgaatttttatcgttattaaattcaggtatgatgcaagccgagtatcgtatggtccctgctactgttgatgtggttactgttaagtcttacgatttggtagaaccacatagtaatcaatttgtctatgccctaggcatgacacaatcacattttccaaagattgctcaaaacaaatctttaatatctgatattgaacgtcagcttataaatgatgccaatgacactgatggtcattttgacattatgacgcaagaaaatttgaagaaaaaccattttgctgccctctctctttttaatgctgctaaacaagaattagtgttgactataccacaattattgaatgagtctgaagatcagatgtcaccatatcttgtcgaactaagagatataggtgttccttttaatcataaaggacgccaatcgttaaaagaagaagctgataatattgggaattacaaagctttattatcgcgtgttgttgacttgtatcgctctgctattgacaaagagatgactaaagaagaacaaactttttggtcagttgctgttcgttatttgcgtcgtcaattaacttctaaagggattgagataccaataattacagatagtcttgatactgtgacagtttcatcagatgtgatgaccagacgcttcccagaagatgacccacttaaattatcctcatctgctttgacaactttttataataatcaatataagtattttttacaatatgtgttaggtttggaagaacaagactcaattcatccagatatgcggcaccatggaacgtaccttcatcgtgtttttgaaattctgatgaaaaaccaagggatagaatcttttgaagagaaactcaactctgcaattaataaaaccaatcaagaagatgttttcaaatccttgtattcagaagatgcagaaagtcgttattctttagaaattttagaagatatcgcgcgtgcaactgcaaccatattacgacaagatagtcagatgactgttgaaagtgaagaagaacgatttgaactaatgattgataatactataaaaattaacggtattattgaccgtatcgatcgtttatctgatggttctttgggtgtcgtggactataaatcaagcgctcaaaaattcgatatccaaaaattttataacggtctaagtccacaattagtcacctacattgatgctatcagtcgtgacaaggaagttgaacaaaaaccaccgatttttggagctatgtacttacatatgcaggaacctagacaagacttgtctaaaattaaaaatttagatgatttagtaacaaaaaatcatcaagctttaacttataaaggattattttcagaagccgaaaaagaattcttagcaaatgggaaataccatctcaaagattccctttattcagagactgaaattgctattttacaagcacataaccaatcgctttacaaaaaagcatctgagactattaagtcaggtaagtttttgatcaatccatatacagaagatgctaaaacagttgacggagatcagtttaagagtattacgggattcgaggcggataggcatatggcacgtgccagagcgctttataaattacctgctaaggaaaaacgtcaaggtttcttaacattaatgcagcaagaggaggaaaatgatgacctttaagcctttcttaaatccagaagatattgctgttattcagacagaagaaaaaaattctgataaaaaacaaaagcgaacgcctgaacaaattgaagccatttatacttttggtaacaatgtcctggtatcagcttcggctggttctggaaagacttttgtaatggttgagcggattttagataaacttttaagaggggttccgattgactctttgtttatctcaacatttacagtaaaagcggcaggtgagctcaaagaacgtttagaaaagaaaataaacgagtctttgaaatccgcagaatcagatgatttaaaacagtttctcacccagcaacttgtcggcattcaaacagctgatattggtactatggatgcttttacgcaaaaaatagttaaccaatatggttatactttgggcatatcacctatatttaggattttacaagataaaaatgagcaagacgtcataaagaatgaggtctatgctgatttattttctgactacatgactgggaagaatgcagcttcattcataaaattagtcaaaaatttctcaggtaatcgtaaagatagcaaagcttttcgagaaatggtttataaagtttatgcttttagccagtccaccgataaccccaagcgctggatgcaaacagtttttctaaaaggtgcacaaacttacactgattttgaagctattccagatcaagaagtttcaagccttttaaatgtaatgcaaacaactgctaatcaattacgtgatttaacggatcaagaagattataagcaattaactgctaaaggggttccgacagcaaattacaaaaaacaccttaaaataattgaaaatttagtccattggtctcaagactttaatttgctgtatggaaaaaaaggattgactaatttggcacgtgatatcactaatgtgattccttcaggcaatgatgttacagttgctggcgttaaatatcctatctttaaacaattgcataatcgtatcgttggacttaagcacttagaagttatttttaagtatcaaggagaatctcttttcttgttagaattattgcaatcctttgttttagatttctcagaacaatatttacaggagaagattcaagaaaatgcttttgaattttctgatattgcccattttgcaattcaaatattggaagaaaatcatgatattaggcaactttatcaagataagtatcatgaagtaatggttgatgagtatcaggacaataaccatacccaagagagaatgttagaattattgtctaatggacataatcgtttcatggttggagacataaaacaatcaatttaccgttttcgtcaggctgatccacaaatttttaatgataaatacaaagcttaccaagacaatccaagtcaagggaaattaattattctgaaagagaattttcggagtcaatcagaggttttagacagtacaaatagtgtgtttacacatcttatggatgaagaagtaggagacattctttatgatgaaagtcaccaattaaaagctggtagtccaagacagcaagaaagacatccgaataataaaacacaagttttactattagatactgatgaagatgatatagatgacagtgatagtcaacaatatgatattagcccagctgaagcaaagttagtcgcaaaagaaattattcgattgcataaagaagagaatgttccctttcaagatatcaccctcttagtttcttcaaggacaaggaatgatggtatcttacaaacttttgaccgttatggtattcctttggtaactgacggtggggagcaaaattacttaaaatcagtcgaagtgatggtaatgcttgatactttgcggtcaattgataatcccttaaatgattatgctctagttgctcttttgagatctcccatgtttggctttaatgaagatgatttaacaagaattgctattcaggatgtcaaaatggctttttatcataaagtgaaattgtcttatcataaagaaggtcatcatagtgatttaattactccagaattatcttctaaaatagatcactttatgaaaacattccagacttggcgtgattttgctaaatggcattcgctttatgatttaatatggaaaatatataatgaccgtttttattatgattatgtaggagctctgcctaaagctgagcaacgtcaagccaatctatatgccttggcacttcgagcaaatcagtttgaaaaaacaggtttcaagggtttatcacgctttattcgaatgattgataaagttttagaaaatgaaaatgatttggcagatgttgaggtggcattaccgcaaaatgctgttaacctaatgactatacacaaatcaaaggggcttgagtttaagtatgtatttattttaaatattgataagaaattttcaatggtagacataacttcccctcttattttaagccgaaatcaaggaattggtattaaatatgttgctgatatgcgacatgaactcgaagaagagatactgcctgcagtaaaggttagcatggaaacacttccttaccaacttaataaaagagagttacgcttagctactttatcagagcaaatgcgtttactttacgtagctatgacacgtgcagagaaaaaattatatctggttggtaaggctagtcaaaccaaatgggctgatcattatgacttagtatctgaaaataatcatctcccattagctagtcgtgagacttttgtgacctttcaagattggttactggctgttcatgaaacctataagaaacaagagttgttttatgacatcaacttcgtatcattagaggaattaacagatcaccacatagggatggttaaccctagtctacctttcaatcccgataataaggtagagaatcgtcagtctgaagatatcgtgcgtgcgattagcgtgttagaatctgttgagcagattaatcaaacttataaagcggctattgagttaccgacagtgagaacaccaagtcaagtcaaaaaaatctatgagcctattctagatatagaaggtgttgatgtgatggaaactattactaaaacatcagtagattttaagttacctgatttttctacaagtaaaaagcaagacccagcagctttaggatctgctgtacatgaattaatgcaacgcatagagatgtcatctcatgtcaaaatggaagatattcaaaaagctttgacagaagtgaatgctgaaacaagtgtcaaagcggctattcagattgaaaaaatcaactattttttccaagaaacctcactcggtaagtatatacaagaagaagtagaacatctgcatcgagaggcaccttttgccatgttaaaagaagatccggagagtggtgagaaattcgttgtacgtggtattattgatgggtatctactattagaaaatcggataattctatttgattataagactgataaatttgtcaatcctctagaattaaaagaacgctatcagggacaaatggctttatatgcagaagctttaaaaaaatcttacgagatagaaaagatagacaaatacttaattcttttaggtggtaaacagctagaagtggtaaaaatggattaaagaaaggaaaaaatgatagtcgaacaaaaatttggaaatggttttacttggattaacattgaagcagagcaattgcgaacagaaacatcggaaattcaagcaaaatatttggatagtgagattattacatatgctctggatgattatgaacgagcctttatggaatgttctcatattaaaggaaaagaagtcttgacgattatttttaatactattgatctaaagcagaaagaaagttattatgagaccgttccgatgaccttttgcttatcacacgaccgtttgataacggtgacacggtctcgaaatagttatatgctagaactattgcaaaaatatctagaccgtaatccagatgtctctcctaaaaaatttttatttgcagctttaactttgattacaaaacaatattttaatgttgtatcgaaaattgatagagaaaaggatattctcaaccgtcaattgagagaacaaacaaccaataagcgcttattagccatgagtgacctagagacaggatccgtttatcttttgacagctgccaatcaaaatgcattggtattagagcaattagatgttcatcctagtcagcgatttaattctgaagtggaaaaagaacagttatcagatgctctcattgaagcgcatcagttagtcagtatgacacaattaaacagtcaggtactttcacaattatcatctacttttaataatgtcttaaataataacttgaacgaaaacttaacaggtttgaatatcatttcgattaatttagcgattattgcagcaattactggcttttttgggatgaatattccattacctcttacagaatcacggagttcatggttaattgttattgctacttcggtcttactttgggttattattgctcaaattttaaaacgagtttttaacttaagaaaataaaaatattcggtgcttacgcaccgaatatttttttatttacctaagcagaattggctgaagagctgagttattagttcatctggagctgcatccccagtgatttctccaagtatttcccaagttctagtcatatcgacttgtaagagatcaacaggcattcctaattccaagccctcattgacagcttttaaactatcaacggctttttcaattagtgagatatggcgagcatttgatagataagtagcgtcatgttctaccataccagcgttgtcaaagaaaatatcgttaatacgttcttcgattttatcgatgttttcattttctaaaaccgaaattggaataacatttttaggtaattcgttaacttctattttttgaggaagatccgttttattgagtaatacgatacgattactttctttacttagttctagaagggagcggtcttgtaatgttagtggttcggaactattgagaaccaacaacacaaggtcggcttcttctaaagccttctttgaacgttcaacaccaattttttcaacgatatcatctgtatcacggataccagcagtgtcaactagttttaaaggaactcctttaatattgacgtattcttcaataacatcacgagttgttccttcaatatctgtcacaatcgccttttcttcacgtaagaggttatttagtaagctggatttaccgacatttggacgaccaatgattgctgttgaaagtccttctcgaagaatttttccacgtctggcagttcgaagtaaattttccataagtgcttgaaactcttgtgttttttcacgcatcagtgttgtagtcatctcttcaacgtcatcatattcagggtaatcgatattaacttcaacttgggctagagtatttaaaatttcttgtcgagtgttattgattagtgtctttaaagaaccatctaattgcttaacggcaatatccattgctttatctgttttagctctaataagatccataacagcttcagcctgagtcaagtcaactcgaccatttaaaaaagcacgtttagtaaattctcctggttcagccattcgtgctccatgtcgtaaaattaactgaagaatttcgttagtaactgcaattcctccatgcgtattaatttcaataacatcttctcttgtgaatgtttttggagcaagcataacgcctaacataacttcatccaagatttcatttttatctgggtccacaatatgaccatagtttaaggtatgggattggatcgcggatagatcttttccacgataaatttttgatgctatctttaaggcatctgtaccagatatacggacaataccaatagctccctcaccgagaggagttgaaatagctgcgatggtatcaaattcttttgtaatagacataaagtctctctctttcttggaaattactaacattcattgtaacctaaagccctaaaaggtgcaatcatttgattaaaagagaagatttccataatggttttatttgaaggtatgctataataaaactatgattatactacaaggaaacaaaattgagcgctcattttcaggtgatgtgctttttgataatattaatattcaagttgatcaacgtgatcgtattgctcttgttggacgtaatggtgctggcaaatcaacgcttcttaaaattttagttggtgaagaggctccgacaaaaggagaaataaataaaaagcgtgatttgagtttgtcctacttggcacaagatagtcgttttcaatctgaaaatacaattttccaagaaatgttacaagtttttgactcattaagagaagtagagaagcgcttacgtgaattggaattacaaatggggcaagtttcaggaagtgacctggaacaattgatgaaaacatacgatattttgtcagaagagtttcgtgaaaaaggtggctttacctatgaatcagatataaaggctattttaaatggttttaagtttaacagtgatatgtgggaaatgcctattagtgaattgtctggcgggcaaaatacacgattagcgcttgcaaaaatgctacttgaaaagccagaattacttgttttagatgaaccaacgaaccatttagacattgatacgattgcttggttagaaaattatcttgtaaattatcaaggagcccttattattgtcagccatgaccgctattttttagacaaggtagctacagtaacttatgatttaacgacacattctctagaccgctatgtaggcaattattcgaaatttatggatcttaaggcagagaaaatagcgactgaagaaaagaattttgaaaaacaacaaaaagaaattgctaagttagaagattttgtacaacgtaacattgttagggcttcaaccactaaacgagcacaagctcgtcgtaaacaattagaaaagatggaacgactcgacaaaccgaatgtagagcaaaaatcagctaatatgacttttcatgctgggaaagtctcagggaatgttgttttaacacttgagaatgcagctattggttatgaaggtgtttctttatcggagccaatcgatttggacgtgaagaaatttgatgctattgcaattgtaggtccaaatggtatcgggaaatcaactttaatcaaatcgcttgttgggcaaattccttttatcaaaggagaagcaaaattaggagcaaatgtcgaaactgggtattacgatcaaagtcaaagtaatttaacaaaaacgaatactgttttagatgagttatgggatgctttttcaacaacgccagaagttgaaattagaaaccgtttaggagcttttcttttttcaggtgatgatgttaaaaaatcagtttcaatgctatcaggtggtgaacgagcgcgtttgctattggcaaaattatctatggaaaataataattttctcatattagatgagccaacaaaccacttggatattgatagtaaagaagtcttagaaaatgcactcatcgaatttgatggcacattactttttgttagtcatgatcgctattttattaatcgtgtggcaactaaggttctcgaaatttctgataagggaagtactctctatctaggagattatgattattacctcactaagaaagccgaactagaggaattagcacgtttaaatgaagaagaagtgagtgcttcaaaaacagaaatcgacgttacatcagattatgagacacaaaaagcaaatcaaaaggaatttaggaaaattacccgtcgcgttgtagaaattgaggcgcgtttggaagttcttgaaaatgatgaaaacaatatcaatggtttaatgttagaaaccaatgacatcggaaaactctctgatttgcaaaaagagctggaatcaatccaagaagaacaattgctattaatggaagagtgggaaaatctaaatatgagactagatttgtgagaaaatttcaaaaacaatagtttgtgaaaaaaagtacattttaaattgagatgccttttacgaaaacaaagaaagcggttcaaattcttgcatcttgtgaaaaaaacttatacaataattaagtaataaagatttttttggaggttagaatggtaactctatctaaagaacaacacttggatatgtttctaaaaatgcaacgtattcgtgatgttgatatgaaatttaacaaattggttcgtcgtggtttcgtccaagggatgactcacttctctgttggtgaagaagctgcttcagtaggtgctatccaagatttaacagattcagatatcattttctcaaaccaccgtggacacggacaaactattgcaaaaggtattgatattggtggaatgtttgctgaacttgctggtaaagcaacaggaacatcaaaaggtcgtggaggctcaatgcacttagcaaaccttgaaaaaggtaactatggaacaaacggtatcgtcggtggaggatatgcgcttgcagtaggtgctgcccttacacagcaatatgaaggaactgataacattgttatcgccttttcgggtgactcagcgactaacgagggctcattccatgagtcagttaacttagctgctgtttggaacttaccagttatcttctttatcatcaacaaccgttatggtatctcaacagacatcacatactcaactaaaattcctcacctttacatgcgtgctgatgcgtacggtattccagggcattatgttgaagatggtaatgaccttatggctgtttacgagaaaatgcatgaagttatcaattacgtgcgttcaggaaatggaccagctattgtagaggttgaatcataccgttggtttggtcattcaactgctgatgctggggtataccgtactaaagaagaagttgattcatggaaagctaaagatccagtaaaacgctaccgtgcatacttaattgaaaatgaaatcgctactgaagaagagcttgcagctattgaagcacaagtgattaaagaagttgaagaaggggttaaattcgctgaagaaagtccattccctgatatgtctgttgcatttgaagacgtttttgtggactaaaataacctaaagtagatgagatttatctcgttctattattcaattgattaaaaaacggatattcggaggaaataatgagcgaaactaaagttatggctttgcgcgaagcgattaatgtcgctatgagcgaagaaatgcgcaaagatgaaaaagtatttttaatgggtgaagatgtaggtgtatatggaggagacttcggtacatctgttggtatgttagaagagtttggtgctaagcgcgttcgcgacacaccaatctcagaggctgcgattgcaggttcagctatcggtgctgcacaaacaggtttgcgtcctatcgttgatttgacattcatggattttgtaacaatcgcaatggatgctatcgttaaccaaggtgctaaaacgaattatatgtttggtggaggtctatcaactccagttactttccgtgtggcatcagggtcaggtattggttcggctgcacaacactcacaatcattagaagcttggttaacacacattccaggtctaaaagttgttgcacctggtactgttaatgagtcaaaagcacttttgaaatcttctattcttgacaataacccagttatcttcttagagccaaaagctctctatggtaagaaagaagaagttaatatggaccctgatttctatattccacttggtaaaggggatattaagcgtgaggggactgacttaacaattgtttcttatggccgtatgcttgagcgtgttatgcaagctgctgaagaagttgctgaggaaggtattaacgttgaggttgttgatccacgtacacttattccgcttgataaagaattaattatcgattctgttaagaaaactggtaaattgatcttggttaacgatgcttataaaactggtggtttcactggtgaaattgcaactatggttgctgaaagtgaagcatttgattaccttgatcatcctatcgtgcgtcttgcaagtgaagatgttccagtaccgtattcacgtgtacttgaacaaggaatcttacctgatgtagcaaaaattaaagatgctatctataaagtagttaacaaaggtaaataattcataaaacaaagagggactgaggaatgagtgaaaacttagcctctttccttgtttataggttttaatttatatcgttagatgaaacatatatttgacgatatagtttagtgtgaaaggaaaactatggctgtcgaaattattatgcctaaactcggggttgatatgcaagaaggcgaaatccttgagtggaaaaaacaggtaggtgatgttgttaatgaaggtgacgtcctacttgaaattatgtcagataaaacaaatatggagattgaagcagaagactcaggtgttttactaaaaatcacacatgggaatggagatgttgttcctgtaactgagacaattggttatattggtgctgaaggtgaagaagtaacagaagcatcttcttctgaaaatacatcagttgaagaaaacgcgacacaagtaacttcagaaccagaaaaagttgaagaaacatcagaaccaagtgtgccagcagctacaagtggtgaaaaagtacgtgccactcctgcagctcgtaaattagcaagagagatgtctattgaccttgcactagtatctggaacaggggcaaatggtcgcgttcacagagaagatgttgaaaacttcaagggtgctcaaccacgtattacaccattggcacgtcgaattgctgaagatcaaggagttgatatagcagaaatcactggcagtggtattcgtggtaaaattgttaaaaatgatgttttggctgctatgtcaccgcaagcagcagaggctcctgtagaaactaaagctacaccaacaacagaagaaaaacaattaccagaaggtgttgaagtcattaagatgtctgcaatgcgtaaggctatttctaaaggtatgactaactcttacctcactgctccaagctttacacttaactatgacattgatatgactgaaatgatggctcttcgcaagaaattaattgatccaatcatggctaaaacaggcttgaaagtcagctttactgatttgattggaatggccgttgttaagacattgatgaaaccagagcatcgatacctaaatgcttcattaattaacgatgcacaagaaattgagcttcataattttgttaatattggaatcgcagttggtcttgatgatggtttgattgttcctgttgttcacaatgctgatcaaatgtcactttctgactttgttatagcatctaaagatgttattaagaaaactcaagaaggtaaattaaaatcagctgaaatgtcaggttcaacattctcaattactaacttaggtatgtttggtactaagacgtttaacccaattatcaatcaaccgaactcagcaatccttggagtaggagctactattccgactccaacagtggttgatggtgaaattgtagctcgaccaattatggcaatgtgtttaacaattgaccaccgtattgttgatggaatgaatggtgctaagtttatggttgatcttaagaacttaatggaaaacccatttggtttacttatttgattccgtaggtcttaatttgatataataagttattcgaaaaacgaaagaggaaataaaaaatggcttttgatgtaattatgccaaaacttggggttgacatgcaagaaggcgaaatccttgagtggaaaaaaaatgaaggtgacaccgttaatgaaggtgatgtccttcttgaaatcatgtctgataaaaccaatatggaaatcgaagcagaagacactggtgtacttttaaaaattgtacatcaggcaggagatgttgttcccgtcactgaagtgattgcctatatcggagaagaaggtgaagaagtaggtacgtcatcaccttcagctgatgcaactatcacagctgaagatggtcaatcagtttctggacctgctgctccttcacaagagacagttgcagcagcaactcctaaagaagaacttgcagctgatgagtacgatatcgtagtcgtaggtggtgggcctgcaggttattacgcagcaatccgcggtgctcaacttggaggaaaaattgccattgttgagaaaactgaatttggcggtacgtgtttgaatgttggttgtatccctacaaaaacatatcttaaaaatgctgaaatcctagatggtttgaaagtagcagctggacgtggtatcaaccttgcttcaactaactatgcaattgatatggataagactgttgcctttaaaaattctgtagttaagacactgactggtggtgtacgtggtctcttgaaagcgaacaaagttgaaattttcaatggacttggacaagtaaaccctgataagtctgttgttattggcgataaagttatcaaaggtcgtaacgtcgtccttgcgactggttctaaggtatctcgtattaatattccaggtattgaatcaccattagtattaacatcagatgatattcttgatttacgtgaaattcctaagtcacttgctgttatgggtggtggtgtcgtaggtattgagcttggtcttgtatgggcttcatatggtgttgacgtaactgttattgaaatggctgatcgcatcattccagcaatggataaagaagtatcgctagaacttcaaaaaatccttgctaagaagggaatgaagattaaaacatcagttggtgtttctgaaattgttgaagccaataatcaattaacgcttaaattaaacaacggtgaagaagttgttgctgataaagctcttctttcaattggacgtgttccacaaatgaatggtcttgaaaatcttgagcctgaacttgagatggaacgtggacgtattaaagttaatgcttatcaagaaacttcaattccaggtatctatgcaccaggtgatgttaatggaactcgtatgttagctcatgctgcataccgtatgggtgaagtagctgctgaaaacgcactcggcggtaataagcgtaaagcacatctagatttcactccagcagctgtttatactcatcctgaagtagcaatggtggggatgacagaagagcaagcacgtgaacaatatggtgacatattagttggtaaaaatagctttacaggcaatggtcgtgctatcgcttcaaacgaagcacatggttttgtaaaagtaattgctgaacctaagtataaagagattcttggtgttcacattattggtccagctgcagcggaattgattaatgaagcttctacgattatggaaaatgagttgactgtctacgatgtagcacaatctatccatggtcacccaacattctctgaagttatgtacgaagctttcttagatgttctcggtgaagctattcacaaccctccaaaacgcaaataattttgtttaatatatttgagattgagcttttatagcttcaatctcttttcacgtatatattgtctgaatattataaaatattagttaggaatttaaaatgaaatatatcgttaacacgtctaatgatccggcttacaatgttgctttagaagcttacgcctttcaaaagttgacagatatcgatgaaatctttattctttggattaatgaaccggctatcattattggacgccatcaaaatacaattcaagaaattaacaaagagttcattgataaaaatggcatccatgttgtccgtcgtttgtcaggaggcggagcagtttatcatgacttgaataatttaaactacactattatttctaataatacacaagaaggtgcctttgatttccaaactttttcaaaaccagttattgatactcttgctaaattaggtgttaaagcagaatttactggtcgtaatgatttagaaatcaatggacaaaaatttgcaggaaatgctcaagcttattacaaaggtcgtatgatgcatcatggttgtcttttatttgatgttgatatgtcagtcttagggcaagcactcaaagtatctaaagacaaaattgaatctaaagggataaaatctgtacgcgcacgtgttacaaatattgttgaccatctttcagataaaattacagtacaagaatttagcgatgccattttagctcaaatgaaggaagaatatccagagatggatgaatatgttttgagtgatgccgagttatcagaaatccaagctatgcgcgataatcaatttgctacatgggattggacgtatggtaaagcacctgaatacaccattgaacgtggtgtccgctatccagctggaaaaattacgacttatgctaatgttgaaaattcaacgataaaatctgtcaaaatctttggtgacttctttggagtgaaacctgtggatgatattgaaaaaatgttggagggtgtccgctacgattacaaagatgttttagcagcgcttaaaacagttgatacaagtcaatacttctcacgtatgacacccgaagagattacaaaagctattgtagactaaaatcaaaaaatctagtcaaagtcttcgcctttggctaggttttttgtatggttaagtgacgttatagtagtaaaaaaacaacgttattgataacgctggtttttatattattcaaaatctgcttttgatttaacgtctccgtattcttcaggaatctctaaagataaaatttcttcataactagggaggacaatctctttaccgtatttgttacggagggcagttgccacaagacggtaagctagattagcattacgagaaaggattggaccgtgaaagtatgacccaaaaacattcttataatgaaccccttcagtaccatcttctttgttattcccatttccataaatgacggttcctaaaggtttttcgtcttctgataaaaaggtacgtccttgatgattctcaaagccataatatgtttcattgaattcatcgttgtgaatcttgatatcaccaatatagcgattattattttggtttagcgtatagtgtcccataacgccaatgccctctattcgttctccattagcttgaatatagtattgtcctaaaagttggaaacctccacaaatagcaagtactacaccattattttgaatgaatttgttaatgtcttctttcttactgggaagatcgcgtgcaacaatggcttgttcgtagtcttgtccaccaccaaaaaatgccatctgataatagttgggatcaaatctatcttctaatgaaacgatatcaaatgtcatttgacatcctagtttttctcccacatatttcatcattaagatatttccgttatcgccataagtatttaataggttaccataaagatgagctacattaagagtgtatttataatctttggtagtaggagattttagtgaggtataagtcattaattcatctcctttctgatagcgttgtggttagcaagaatttcacgaaactccagcatagctgtatatgttgctaaaatataagcatgctcagtctcttgctgctcaatcattgtcataatatcttgcagtttatcagcttgttttatgcgtttctcatcataaccagttacacgtaagcgacgagcaatttcagagtggcgaacaccaccagcaaatatttctgggatattcatcgtgagaatagtttcaaaattagcgtcccaaatccaagaagtatcaataccgtcagcataattggcattcagtagtactgagagagagaacgggtatggagcaagtttaatcatatcaagagcttgactagctcctaccggatttttaatcagaactaaagtacattttttatttccaattgtaaaggtttcttgacgaccaaaaacggcacggcttttatcaaatccatccttaatttgacttggttctacaccaaaatattcagcaacagatactgccgccaaagcattgtaaatattataaaggccacccacgttgatattatattgttggccatcaataacgaaacctgatgaagtatttgtcagatgtgttagccttgttaaggcataatcaaggtttggacgttcaaaatcacaattaggacaagtgtagtcaccaaggttggcatatgtgttcaatcgataagttaaaattgcttgacactttggacagagaataccctcagtattatagtgtgctaatcgtggctcatgtttgtcggtattaaatccatagaattgcacagggttagtcacgcttttagaattaaaaagtggactgtcaccgttagctaagatagtagcttgcggagcgttagcagctccatctaaaatcatttgataagttgtgtagatttcgccataacggtccatttgatcacggaaaatattggtaaagacgaacaaactaggctttatatactgtgtaatacggggtaaactcgcttcgtctatttcaaggacagctatttttttaccagatttacttttcttagctgttaggaaggtcgaaacaatacctgtaatcatatttgctccacttgggttggttaccacctgaccgaaggcttcctttaaaataccaactgttaaagctgttgttaaggttttaccgttagtaccagtcacaactacaatttcataatctttggcaattgtatctagtatatctttatcgaatttgagtgctaaactacccggataagtagagccacgtcccattttacttaaaaggtaatgagcagacttaccggcagccactcctagtgctgtatttattttcataaagatattttatcataaaaagatgctttcttgctaaagaaaatattatgaaaacatggtataatgtagacgatggaaaataagaaatcaaggagttaagcaagaaactcttcgacaggctaccagtagagaggaagatatggatattttttcagctattgattcaaagttttgggcgagcattatggaaaatccatggatgatccttattcatctcatggatattatcatagtagctgttctgatttataaatttatcaaagcgctagcaggcacaaaaattatgtccttaattcagggcgttattttgtttatcatcattagatttgtgtcagaatggatagggctaacaacgattacatttttgatgaatcagattgttacttatggtgtaattgcaggtgttgtcatctttgctccagagattagaacaggtctcgaaaaatttgggcgaacaccacaactatttacgcaacgttctcaattaagcagtgatgaaaagctagtagatgcccttgttaaggcagttgcttatatgagtccgcgtaaaataggagccttgatttcaattgaacgtacccaaactttgcaagagtatatagctacaggtatcccattagatgcagatatttccagtgaattgttaattaatattttcattcctaatacaccactgcatgatggtgctgttattgtaaaagataaaaaaattgctacagcatgctcgtacttacctctatcagaatcatcttcgatttcaaaagaatttggaacacgccacagagcagcgattggtctatcagagaattcagatgcactaacagttattgtttctgaagagactggtggtatttctgttgctttgaaaggtgaatttttacatgatctttctaaagatagctttgaagcaattctgagaactcagttgattcaaaatcaagaggaaaactcaaaattagcttggtataatcaactattgaggaggaagtagacatgaaaaaattttttacaaataaattttggttaggcgttgtctcactctttctggctattttattatttttaacggcaactgcaacaagtatgaaccatcaagacaatagtaagattgcaggagcgtctgagacatatacacataccctaacagatgtgccaatagacatcaaatacgatagtgatgattactttattagtggatattcttatggggcagatgtctatatgtcatcggttaatcgtgttaagttagattctgaaataaatgaggatacacgaaaatttaaagtagtcgccgatttgacaaatatgaaaccagggactcacaaagtcccactaaaggtagtaaatttgccatctggtgtaaatgctacggtttctccaacaacaattacagtaactatgggtaaaaagaaaacaaaagagtttccggtttatggacatgttaatgataagcaaattaaagctggttatgcagtcgataagatgtcagttgatgtgtcaaaagttaaagttactagtgatgaatctattatagatcgtattgaccatgtcgctgccaatatccctgatgataaagttcttgatgatgattttaacaagacagttactttacaagctgtaacagcagatggtacagtattagcaagtattattcacccttctaaagcaactttatctgtcaaagtaaaaaaattgaccaagacagtaccgattaatttgataccagtaggacaattcagcgatagtatttcaaaaattaactacaagttgagtcaagaaaaagcagtaatttcaggaacaaaagaggctttagaagctatttctgttattaatgctgaggtagatatttcagacgtaactaaaaatacagaaaagaaaattaatctttctgcaaacaatgtttcagttgatcctgctcaagtaacagttcaattgacaactactaaaaaataatagataataaaaacgaaaaaaatggaggtagcgtttttcgctagaaaaaaattatgggaaaatattttggtacagatggtgttcgcggtgaagctaatgttgaactgacgccagaattggcttttaaattaggacgttttggaggatatgttctaagtcaacacgaaactgatcgtccgagagtttttgtagctcgtgatactcgtatttctggtgaaatgctggaatctgctttgattgctggtctactttcagtaggtattgaggtttataaacttggtgttttagccactcctggagtgtcttaccttgtccgtacagaaaaagctagtgcaggggttatgatttcagcaagccacaatccagcacttgataatggtattaagttctttggtagtgatggttttaaacttgatgatgatcgtgaattagaaattgaagctttacttgatgcgaaggaagacactttaccacgtccatcagcacaaggtttaggtactttagtagattatcctgaaggacttcggaaatatgagaagtttatggaatcaactggtattgatttagaaggtatgaaggttgcgttggatacagcaaatggagcagcaacagcctcagctcggaatatctttttagacttgaatgctgatataagtgttattggtgatcaaccagatggtttgaatatcaatgatggtgttggttcgacacatcctgagcaattacaaagtttagttagagaaaatggttccgacatcggtctagcttttgatggtgatagtgatcgtttgatcgctgttgatgaaaatggagagattgtagatggtgataaaattatgtttatcattgggaaatatctctctgataaagggcagcttgctcagaatacaatcgtaacaacggttatgtcaaatctcggctttcataaagcgctcgaccgtgaaggaattcataaagcgattaccgctgtaggagaccgctacgtggttgaagaaatgcgtaaatcaggatataatcttggcggagagcaatcaggccacgttattatcatggattacaatactacaggggatggacaattaacagccatccaattgactaaggtcatgaaagaaactggtaagaaattatcagagttagctagtgaagtgacgatttatcctcaaaaattagtaaatattcgtgttgaaaataacatgaaagataaagcgatggaagttcctgcaattgcggaaattattgctaaaatggaagaagagatggatggcaatggtcgtattctagtacgtcctagtggtactgagcctcttcttagagttatggcagaagcgccaacaaatgaagcggttgattattatgttgatactatcgcagatgtcgttcgtacagaaattggtttagattaaaacggcgttattctgctataaagtcgtcaatgttataaaataataaagagatggaattggagtggagcatcaagcatacgcctttctctctctttttgatttgagaagggagtttagagaaaatgactaaagaagcagaattattatgggctaaacacaagtatttagtcttaagtaaatctcagaaaatttatttggatattagacaaactttgaaatcaccaaattgtaccgttttagacgttcagtcactcattgaccaagcagtgcttttagaagaatcaccatcacaagtgactaatgcttatatgcatatatggggctattttaaaaataaggcagagcgtcaagaaaaagaagaatttttaaccttgctggaaaaatacaggaaaacaggttatcaacgaagaaaactgttagcttttctaaaacagctattagctaaatacccaaattcttatttacaaaactcttctattttcgaagaagagtaaaagattgatagttgaggtatataaatgagattatggcatcaagatattattgagttattgcctaggcagcaacttttaggacagcatagagagtgttgtgcattgagagggaatgggtgggggagaaaacatgagactgttgattatgtttttcgatattcaccttataggttatttgcatatcatcaattagttatggaagaaatgatggagcgtgggtatcgtgtatctaaagaatggctaattgcagaatataggggaatgaagtgcccaagatatgatacacttaatcctgttgacttggagacacctatctatcccgagcacaatcaagactatctacaagaatgtctatggaatttaaaagcaaaaggaattgaccttcctataaataagataaaatagagatttatctctattttattttggaataaaaagctatattatcaagttttagaggagtgtttttttaagggcaaagtggtaaaatagaaacatgttaaagaaaccaacctcagcatatgtacacattccattttgtacccaaatatgttattattgtgatttttcaaaagtttttattaaaaatcagcctgtagacgcttatcttcaggctcttatccgtgaatttcggtcttatgatattacagaattgcgcaccttatatattggaggagggacacctacatctataagcgctgtgcaactggactatttattgacggagttaagtagagatttaaacttaaatactttagaggagttcactatcgaagctaatccaggagatttaaccgttgataaaatagaggtgcttcaaaagtcagctgtcaatagagtttctctaggagttcagacctttaatgataaacatttaaagcgtattggacgcagtcacaatgaggcacaaatttattctacaattgatgctcttaaaacagctggttttcaaaatatctctattgacctaatttatgccttacctggacaaacgatggatgatgttagaagtaatgtagccaaagctctctctctaaatattcctcatttgagtttatatagtttaattttagaacaccatactgtatttatgaataaaatgcgtcgtgggaaattacatttgccaacagaagatttagaagccgagatgtttgaatatatcatttctgaaatggaaagaaatggttttgagcattatgaaatttctaattttacaaagccgggttttgaaagtcgtcataatttgatgtactgggataatgtagaatattatggtgttggtgcaggcgcttctggttatcttgatggtattcgttatcgtaatagagggccaatacaacattatctaaagggggtttcagaaggtaatgcaaggttatctgaagaagtattatcaaaaaatgaaatgatggaagaggagcttttcctcggtcttcgtaaaaaagagggtgtttccatcggaaaatttgaacaaaaatttggaacgtcctttgagaaacgttacggtcagattgttcaagaactccaaagtgatgggcttttgaaagaaaataatggttttatccagatgactaaaaaaggtctcttcttaggagatacggttgccgagaaatttattgtggagtaaaaaatgggtttattatatcgagaaacttacgaagtgcctttttatgaatcagacactaatcattatatgaaattaccgcagttgttggctttagcgttacaaatttcagccaaacaatctttaaaattaggaataggcgatgacatcgtttttaaaagatacggattggtttgggtcgttacagattatattattgatattgagcgtttacccaagcatgctgaaaagatagtcattgagactgaagccaaagctcataataaattattgtgttaccgctatttttatatttatggtgaagacgggcaaaaaataataacgatttcatctgcttttgtcttaatggattttaaaacacggaagattcatcctgttcttgatgatattacttcaatttaccaatcccaaagaatcaaaaaagttattcgagggccgaaatatcatcccattggagatagtaaagttaaacaataccatgttcgttattttgatttagatatgaatggacatgttaataatagtaagtatctagaatggatgtatgatgtgttggacttagattttctaagtagccacattcctaaaaaaattgatttaaaatatattaaggaaattcaatatggaacggatattaagtctcattggtatcaagatggtcttgtgacacgtcatgatattattggtggcgatgctattcatgctcaagctaggattgaatggcaggaaaaaaaggaggattaaatggcttataaaggatatcttattgatttagatggtactatttacaaagggaaaagtcgtatcccagcaggagagcgttttatcgaacgtttgcaagaaaaaggcattccttatatgttagtaactaataatacgactcgtacaccagaaagcgttcaggaaatgcttcgaggcttcaatgttgaaacaccacttgaaacaatctataccgcaactatggctacggttgactatatgaatgatatgaaccgtggaaaaacagcttacgttattggtgaagaagggcttaaaaaagctattgcagatgcaggttatgtggaggatacaaaaaatccagcctatgtggttgttggtttagattggaatgttacttatgataaattggcaactgctacgttagcaattcaaaatggtgctttatttattggaaccaatccagatttgaatattcctactgaacgtggtttattacccggtgctggctccttaaatgctttattagaagccgcaacgcgtataaaaccagtctttattggaaagccaaatgccatcattatgaataaggcacttgaaattttaaatattcctagaaatcaagcagtcatggtcggtgataattatttgacagatatcatggctggtattaataatgatattgatactttgttagtaacaacgggttttacaacagttgaagaagtaccagatttaccaattcaaccaagttatgttttagcaagtttagatgaatggacatttaatgaaggataagttattagtagttttaacttggatttggattatatcgttagcaactctagctacaatttatattgcttggttgatctatcctatagaaattcagtttttaaaattagaaaaggttgtgtatttaaaggctgaaacaatttattataattttaataagttgatgatatatctgactcatccttttatctctgatttaaatatgcccagctttccttcttcagaggatggtttaaagcattttgcggatgtaaaatatctttttactctagcgcatgggctttttgttatactaacttttccagttatttattttttaagacgtggatggaagcaaaaaagtatctttctatatgaaggctttttcaagatagctattatgttgcctatttttattgtagtatgtgcctttctgttgggttttgaccagtttttcactctatttcatgaggtgctttttccaggagattctacttggcaatttaatcctctaacggatccagtaatttggatacttcctgaaacttttttcctccattgtttcatcatttttttgttaatctatgaaacaataactataattcttttgataataggtagaaaacatttaaaattaagaaaatataaaaacaaaatgcaagccttataatagcgcttgcattttgtttgctatttttttataatacaaatatgagaaatgtcggaattataacaatgacataaaaaagcaccgaatcggtgctcactttttcaagctgaatacggactggattaaaaatcactgccttattttaacgtgctgtgctgtttcgaataattccaacaaaattattatatgttattttagtgtaataatcaagtaaaaaataaaaatcagcaaagctttaaaacttaaaacatactttaggatattttaacaaataacagatgaaagataaagataatgcttttaaaattcaaaaaaataatatataattaaagtatgttttaaaggtgttgtttttagaatggtgttttaaataaaaggagaaaagttatgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagagggagcaagtatcctatctttgcaacattgcaggaagagaaagattatcatgaaaaattttcgacaatctatcatttgagaaaagaattagctgacaagaaagaaaaagcagaccttcgtcttatttatattgctctagctcatatcattaaatttagagggcatttcctaattgaggatgatagctttgatgtcaggaatacagacatttcaaaacaatatcaagattttttagaaatctttaatacaacttttgaaaataatgatttgttatctcaaaacgttgacgtagaggcaatactaacagataagattagcaagtctgcgaagaaagatcgtattttagcgcagtatcctaaccaaaaatctactggcatttttgcagaatttttgaaattgattgtcggaaatcaagctgacttcaagaaatatttcaatttggaggataaaacgccgcttcaattcgctaaggatagctacgatgaagatttagaaaatcttcttggacagattggtgatgaatttgcagacttattctcagcagcgaaaaagttatatgatagtgtccttttgtctggcattcttacagtaatcgacctcagtaccaaggcgccactttcagcttctatgattcagcgttatgatgaacatagagaggacttgaaacagttaaaacaattcgtaaaagcttcattgccggaaaaatatcaagaaatatttgctgattcatcaaaagatggctacgctggttatattgaaggtaaaactaatcaagaagctttttataaatacctgtcaaaattgttgaccaagcaagaagatagcgagaattttcttgaaaaaatcaagaatgaagatttcttgagaaaacaaaggacctttgataatggctcaattccacaccaagtccatttgacagagctgaaagctattatccgccgtcaatcagaatactatcccttcttgaaagagaatcaagataggattgaaaaaatccttacctttagaattccttattatatcgggccactagcacgtgagaagagtgattttgcatggatgactcgcaaaacagatgacagtattcgaccttggaattttgaagacttggttgataaagaaaaatctgcggaagcttttatccatcgtatgaccaacaatgatttttatcttcctgaagaaaaagttttaccaaagcatagtcttatttatgaaaaatttacggtctataatgagttgactaaggttagatataaaaatgagcaaggtgagacttatttttttgatagcaatattaaacaagaaatctttgatggagtattcaaggaacatcgtaaggtatccaagaagaagttgctagattttctggctaaagaatatgaggagtttaggatagtagatgttattggtctagataaagaaaataaagctttcaacgcctcattgggaacttaccacgatctcgaaaaaatactagacaaagattttctagataatccagataatgagtctattctggaagatatcgtccaaactctaacattatttgaagacagagaaatgattaagaagcgtcttgaaaactataaagatctttttacagagtcacaactaaaaaaactctatcgtcgtcactatactggctggggacgattgtctgctaagttaatcaatggtattcgagataaagagagtcaaaaaacaatcttggactatcttattgatgatggtagatctaatcgcaactttatgcagttgataaatgatgatggtctatctttcaaatcaattatcagtaaggcacaggctggtagtcattcagataatctaaaagaagttgtaggtgagcttgcaggtagccctgctattaaaaagggaattctacaaagtttgaaaattgttgatgagcttgttaaagtcatgggatacgaacctgaacaaattgtggttgagatggcgcgtgagaatcaaacaacaaatcaaggtcgtcgtaactctcgacaacgctataaacttcttgatgatggcgttaagaatctagctagtgacttgaatggcaatattttgaaagaatatcctacggataatcaagcgttgcaaaatgaaagacttttcctttactacttacaaaacggaagagatatgtatacaggggaagctctagatattgacaatttaagtcaatatgatattgaccacattattcctcaagctttcataaaagatgattctattgataatcgtgttttggtatcatctgctaaaaatcgtggaaagtcagatgatgttcctagccttgaaattgtaaaagattgtaaagttttctggaaaaaattacttgatgctaagttaatgagtcagcgtaagtatgataatttgactaaggcagagcgcggaggcctaacttccgatgataaggcaagatttatccaacgtcagttggttgagacacgacaaattaccaagcatgttgcccgtatcttggatgaacgctttaataatgagcttgatagtaaaggtagaaggatccgcaaagttaaaattgtaaccttgaagtcaaatttggtttcaaatttccgaaaagaatttggattctataaaattcgtgaagttaacaattatcaccatgcacatgatgcctatcttaatgcagtagttgctaaagctattctaaccaaatatcctcagttagagccagaatttgtctacggcgactatccaaaatataatagttacaaaacgcgtaaatccgctacagaaaagctatttttctattcaaatattatgaacttctttaaaactaaggtaactttagcggatggaaccgttgttgtaaaagatgatattgaagttaataatgatacgggtgaaattgtttgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaagggtaaagcacaaaaactaaaaacagttacggaacttttaggaattaccatcatggagaggtccagatttgagaaaaatccatcagctttccttgaatcaaaaggctatttaaatattagggctgataaactaattattttgcccaagtatagtctgttcgaattagaaaatgggcgtcgtcgattacttgctagtgctggtgaattacaaaaaggtaatgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaagataataaggaaaatatatcagtagatgaacttgctaataatattatcaatctatttacttttaccagtctaggagctccagcagcttttaaattttttgataaaatagttgatagaaaacgctatacatcaactaaagaagtacttaattctaccctaattcatcaatctattactggactttatgaaacacgtattgatttgggtaagttaggagaagattgatatggcaggttggcgaaccgttgttgtaaatacacattctaagctctcttataaaaataatcatctgatttttaaagattcttatcagacggaaatgattcatctatcagagattgacattctaatcatggaaacaacagatatcgttttgtcgaccatgctgattaaacgtttggttgatgaaaatattttagttatattttgtgacgataaacgcttgccaacagctatgttaatgccgtactatgccagacatgattcgagtttacaattatctaggcagatgtcatggattgaagatgtcaaagcagatgtttggacatcaattattgcacaaaaaattttgaatcagtctttttatctcggtgagtgttctttctttgaaaaatcccagtctattatgaatctctaccatgacttagaaccttttgatccttctaatcgtgaggggcatgctgctaggatttatttcaatacactttttggaaatgatttttcaagagagcaggataatccaataaatgctggtttagactacggatattcattgcttttgagtatgtttgcgcgtgaagttgttaagtgtggttgcatgacacaatttggcttgaagcatgctaatcaatttaatcagttcaacctagcaagcgatattatggaaccatttcgcccaatcgttgataggattatttatgaaaataggcagagtgattttgtcaaaatgaaaagagaactcttttctatgttttcagagacatacagctacaatggtaaagaaatgtatctctcaaatattgtcagcgactataccaaaaaagttattaagtcgctaaatagtgatgggaatggaattccggagtttaggatatgagttatcggtatatgcgaatgattttaatgtttgatatgcctactgaaacagcagaagaacggaaggcgtatcgtaagtttagaaagtttctcttgagcgaaggctttatcatgcatcagttttctgtttatagtaaattattactcaataatacagctaataatgctatgataggtcggcttaaagtgaataatcctaaaaagggtaatatcacactcttaacagttacggaaaaacaatttgcgagaatggtttacctccatggagaacgcaacacaagtgttgccaactctgatagtcgcttggttttcctaggagattcttatgatcaagattaattttccaattttagatgaaccattagtgttaagtaatgctacgattttaacgatagaagatgtttcagtttattcttcattggtgaaacatttttatcaatatgacgtagatgaacatttgaaattatttgatgataagcagaaaagtctgaaggcaacagagttaatgctggttacagatatcttaggatacgatgtcaactcagcacctattctaaagttgatacatggtgacttagaaaatcaattcaacgaaaagccagaagtgaaatcaatggtagaaaaattagcagctactattacagaacttatcgcatttgagtgtctagagaatgagcttgatttagaatacgatgaaattaagattttagaactcattaaggcactgggagtcaaaattgagacacagagcgacactatctttgaaaaatgttttgaaattatacaagtttaccattatttaacgaaaaagaatctcttggtttttgttaatagcggagcttatcttaccaaagatgaagttataaaattatgtgaatacatcaatttaatgcaaaagtcagtactctttctagaacctagaagactctatgatttaccgcaatatgttattgataaggattatttcttgataggcgaaaatatggtataatattagtaaaagcacagtaataacaaggaatcatcgaaactgaagtcctgctgagacgaatggcgcgattacgaaagctcaaaagaaaattttctacgaggttttagagctgtgctgtttcgaatggttccaaaactaattgccaatgcttacaatatcttcgtcagttttagagctgtgctgtttcgaatggttccaaaacatgttctgaattacctttctcgacactccggttttagagctgtgctgtttcgaatggttccaaaacaccatcaaggctcttatctgcagattgttagttttagagctgtgctgtttcgaatggttccaaaacaaatggttgccaatgactttctagagtgatgttttagagctgtgctgtttcgaatggttccaaaacacaaaatcttttgttgctcctggacgtattgttttagagctgtgctgtttcgaatggttccaaaacatgtaaggtattgtaaaacttcttcttgcggttttagagctgtgctgtttcgaatggttccaaaacactgttcctataattaaaataaaagaggtagttttagagctgtgctgtttcgaatggttccaaaactgttccagtaaaaagtaattttaaagcattgttttagagctgtgctgtttcgaatggttccaaaaccgctcgattgatgctatcaactatattgaagttttagagctgtgctgtttcgaatggttccaaaacttcttcaagagaacttgtagaacagcttcagttttagagctgtgctgtttcgaatggttccaaaacaaggtacttttagcttgttcttgtggtgttgttttagagctgtgctgtttcgaatggttccaaaacacagctactgtaaattctgcttttacggttgttttagagctgtgctgtttcgaatggttccaaaactagtgcagttgtcaaggagattgtgagcgagttttagagctgtgctgtttcgaatggttccaaaactttaacctttgaaaatgtgaaaggctcgtagttttagagctgtgctgtttcgaatggttccaaaacgcgatgatggtaagtcatcatggacagcgtgttttagagctgtgctgtttcgaatggttccaaaacttttacacacgatgtcagatataatgtcaagttttagagctgtgctgtttcgaatggttccaaaacagtactgcactaggaattgtagagatcaaagttttagagctgtgctgtttcgaatggttccaaaaccgtaccatctatcaatttaccgcaagctgtgttttagagctgtgctgtttcgaatggttccaaaacttaaaagatttaaactatcaagcgtcaattgttttagagctgtgctgtttcgaatggttccaaaacttctaaatgctggtgactgctttgcataaagttttagagctgtgctgtttcgaatggttccaaaacttgctgctagacccaaacagtttatttttaggttttagagctgtgctgtttcgaatggttccaaaactccttttttagataatgtgcgatcacggacgttttagagctgtgctgtttcgaatggttccaaaacttttaccaatgcttccatatcgcttatatgttttagagctgtgctgtttcgaatggttccaaaactggttatacatttactaatccatcagcattgttttagagctgtgctgtttcgaatggttccaaaacaagctaattctcatctcaccgagatggatagttttagagctgtgctgttattatgctaggacatcattgtggtgttctagttttttgttatactgaaataaattttcagagaatgtgggggaaggcggtaattagattaattcaagacgtaattcagaacttagttggccaagctaacgaaatcaccccaatttatcagtttgattgggaaacttatatattggcgactaaaaaatatgaacgtcatttagaggtgtgtctattagtagaaaattcgaattgtttttcggattcaaagataatgtgtcaataaaagagatatgaaaggctataattccaaccttatggttaaagggctaggttgttctacgctttacttaattattagtttgacagcgttggttcttttagtgattgctggtgttttctttgtcattaatacttgcaagcttacaaggaaagcagtggagaacctatccataatcaactaacagctatgatggatctcacctattaatatagttaaggagtgtccaatactccttttttgaaatacagttggaagttacagaaaacatattttcatgttataatagtggagaaagaaatgaggtgctaatattatggaacaaaccttttttatgataaaacctgatggtgtaaaacgtggttttattggagaagttattagtcgtattgagcgtcgaggcttctctattgatcgcttagaggttagatatgcagatgcagatattttgaaaagacattatgcagaactgacggatagaccattctttccaacattagtagattatatgactagtggtccagtaatcattggagttatttcgggagaagaggtcatttcaacttggcgcaccatgatggggagtactaaccccaaagatgcccttccaggaactattcgaggagattttgcacaagctccctctccaaaccaagcgacatgtaatattgttcatgggtcagactcacctgaatctgcaactcgcgagatagccatttggttcaataactaatagacttaatgaagattgatgttcaagtgttaattctcttttacatcggtcttctttttgatataatattctagagtctataggactgttttaatactttagaagttaaacatatcaaattgtataggaaatagaatgaatattgaagatttgaagaaacgtcaagaaaagattagaaacttttcgattatcgctcatattgaccatggaaaatcaaccttagcagaccgtattttagagaaaacagaaacggtttctagtcgtgaaatgcaggcgcaactgttggactctatggatctagaacgtgagcgtggaattactataaagttaaatgctattgagcttaattatactgctaaagatggtgaaacttacatttttcacttgattgacacgccagggcatgttgacttcacatatgaagtatcacgttcattggcagcttgtgagggtgctatactggttgttgatgcagcccaaggaattgaagctcaaactctggcaaatgtttatttggctctagacaatgatttagagatactaccagttattaataaaattgatttaccagcagcagatccagaacgtgtacgtgcagaagtagaggatgttattggtctagatgcttcagaagctgtgcttgcctcagctaaggcagggattggtattgaagaaattttagagcagatcgttgaaaaagttcctgcaccgactggggaagtagatgctcctcttcaagctctaatttttgattctgtttatgatgcttatcgtggagtaattcttcaagtaaggattgtaaatggtatggttaagccaggagataagattcaaatgatgtctaatggtaaaaccttcgacgttactgaggttggtattttcactcccaaagcagttggacgtgattttttagcaactggagatgtagggtatattgctgcctcaattaaaacggttgctgatacacgtgttggtgataccattacccttgctaataacccagcaatagaacccttgcatggctataagcaaatgaacccaatggtttttgccggtctttatccaattgaatcaaataagtataacgatctgcgtgaagcccttgaaaaattacaattgaatgatgctagtctacagtttgaaccggaaacatcacaagcattagggtttggtttccgttgtggtttcttaggacttttacatatggacgttatccaagagcgcttggaacgagagttcaatattgatcttattatgactgcaccatcagtagtttatcatgttaatacaactgacggtgaaatgcttgaagtttcgaatccatctgaatttcctgatcctactcgtgttgacagcattgaagaaccatatgttaaggcgcaaattatggttcctcaagaatttgtcggtgctgtaatggagttagcacaacgtaaacgtggtgactttgtaacaatggattatattgatgataatcgtgttaatgttatttaccaaattcctttagctgaaattgtgtttgacttctttgataagcttaaatcatcaacacgtggctatgctagttttgattatgaaatttccgaatatcgtcgctcacaattagttaaaatggatattcttttaaatggtgataaagtggatgctttaagctttattgttcacaaagaatttgcctatgaacgtggtaaattgatcgttgataagttgaaaaaaatcattcctcgtcagcagtttgaagttcctatccaagcagctattggacaaaaaattgtggcccgttctgatataaaagcactacgtaaaaatgtcttagcaaaatgttatggtggtgacgtttcacgtaaacgtaagttgcttgaaaaacaaaaagctggtaaaaagcgcatgaaagcaattggttccgtcgaagttcctcaggaagctttcttaagtgttttatcaatggacgatgatgacaaaaaataattcagaaagatgatatcatttatctattttaaagtaacttagcttcgtgcttaagttactttttctttgtctgcaattatcaaataatatggctttataatatatttgtttaaatataaatgagctataaatgagtttttgttagtaactaaataataaaaagatggcaaatagtattgcaaaaagaaaaacatctgatataattaactagttaactaaaacgaaaaaaacatttatggaggactcatgaaaggtcaaaaaattattgctctagctggtcttgtcctgtcatgccattttgctcttacggcatgtcatactcaagaacacaaaaattctcatcatattaaaacaaagcaggttgctaagaaaaaagctaataaaaagaaagtctctgttaaggaaagtcataaaaaacgcaagggtgttgcaggggttgactttccaactgatgatggctttttactgactaaagattcgaagattttatctcatacagattctggaatcgttgtagcacatggaaatcattctcattttattttttactctgatttaaaaggttcaaaatttagctatttaatccctaatgctaatacaaaaactaataaaaatcaagcggtaagaaactttaaagcaggggcggtagctgttaatacattaaatgatggctatgtttttaatcccgcagatattgtttcagaagatgctaatggctacgtggtcagacatggtgatcatttccactatattccaaaagcaagtttatctcagcaaaagcaagtacaagcaagtagagctgtttcacgtttaggaaatcaaagtaatagccattacagggttaatagttctaaaattgcagggcttcactacccaacaagtaatggtttcttatttaatggacgaggaataaaaggcactaccccaacaggtattttagtagaacatcataatcatctgcattttattagttttgctgatttaagaaaaggggggtggggatcaattgctgaccgttaccaaccacaaaagaaagctgattctaaaaaacagtcaccatcaagtaaaaagccaagaactgaaaatactttacctaaggacatcaaagataagctagcttaccttgctcgtgaattacatttagatatttcacgtatcagagtccttaaaacactaaatggtgaaattggatttgaatacccacatgatgatcatacacatgttattatggccaaagatattgatctaagtaagccaattccaaatccacatcatgatgatgaagatcatcacaaaggtcatcaccatgatgagtccgaccataagcatgaagaacacgagcacactaagtcaaataaattatctgatgaagatcaaaagaaattaatttatttagcagagaagcttggtttaaatcctaatcaaattgaagtattaacgtcagaggatggaagtatcatctttaagtatccacatgatgaccactcacacaccatagcaagtaaggatattgaaattgggaagcctatcccagatggacaccacgatcactctcatgcaaaagataaagttggtatggcaactctaaaacaaattggttttgatgatgagattattcaggatattctgcatgcagatgctccaacaccattcccatcaaatgaaactaatcctgaaaaaatgcgtcagtggcttgcaactgttactaagattaacattggacaaagaaccaatccattccagcgttttggtctatcattgatgcctaatattgaagttctaggaattgggtttactccgattaatgatatgacgccagttttgcaattcaaaaaacttaaacagctttggatgacaaatactggtattacagattattctttccttgataagatgccactattagaaggattggatatttcacaaaacggtattaaggatttatctttccttacaaaatataaacaattaagtcttattgctgcagctaataatggcattacttcgctaaaaccattggctgaattaccaaaccttcaattcttagttttgagtcataacaatatctctgacttgacaccgttatcaaacttgacaaaactccaagaattgtaccttgatcataataatgtgaagaatttaagtgcactttctggtaaaaaagatttgaaagttctagatttatcaaacaataaatccgcagacttatcgactctaaaaacaactagtcttgagacgcttcttttaaatgagacgaatacaagcaatctaagtttcttaaagcaaaatcctaaggtatctaatttaacaattaataatgcgaaattagcatcattagatggtattgaagagagcgatgaaattgttaaagtagaagctgaagggaaccaaattaagtcactagtattgaaaaataaacaaggttcgttaaaattcttgaatgtgactaataatcagttaacatcacttgaaggtgttaataattatacttcacttgagaccttaagtgtttctaaaaataaacttgaatctttagatattaaaacacctaacaaaacagttacaaatcttgattttagccataacaatgttccaacatcacaattgaaattgaatgaaaaaaatattcctgaagcagtagctaagaattttccagcagttgtagaaggttcaatggttggaaatggtagtcttgctgaaaaagcagctatggcttctaaagaggacaaacaagtttcagataatactaatcaccaaaaaaacactgaaaaatctgctcaagcgaatgctgatagtaaaaaagaaaaccctaaaacacatgatgaacatcatgaccatgaagaaacagatcatgcacatgtaggtcatcatcaccattaatcttttacagagctaatatataaaatccttcaagaatttcttggaggattttgcatttatatgctaaatcatttatttttttagaaaattagctataatatgactatggttaaaagagaagatgtgattttaaatgcaactgaaaatatggttcaccataaattaaaaaatgatccaagtggccatgactggtttcatattgttagagtaagaaatcttgcggtagaattagcacacaaagaaggggctaatacctttatttgtcaaatggctgcacttttgcatgatattattgatgacaaaatctgccaagatagtaagcaagcgtcgtatgaattgactcaatggttatatagtcaagatcttgccatagcagaagtagaacatatccttgatattcttgaaaatatttcattcaaagcaggaactggattgactatgaaaacattggaaggtcaaattgttcaagatgcagatcgcctagatgctatgggggctattggtattgcaagaacgatggcttattcagggagtaaaggacgtttaattcatgaccctaacttaaaaccacgagaaaacctcactttagaagagtatcgtaatggtcaggatacagctatcattcatttttacgaaaaattattaaagttaaaagaccttatgaatacaaaacaagggaaaatgcttgctcaaaaacgtcatgattttttagaactatatttagccgaattttatgctgaatggaatggtaaacgttaggagtagatatgattcgtagagcgaaagaaaaagatttgcctgatattgcagagctattgaaacaaattttaatgttacatcatgaggttcgcccagatatttttcatacaagaggaagtaagttttctaaagaacaattgaaagaaatgctgatagacgaatcaaagcctatctttgtttatgaatcagacgagggtaaagttgttgcccacttgtttcttcaattacaagaaaaacgtgacttacctcgaaagtcatttaaaactctctatatagatgatttgtgcattgatgaggaagtaagaggtcagcaaattggacaaaagttgatggattttgcaagacaatatgctaagaaacatgggtgttataatataactttaaatgtttggaatgataatcagagagcggtctctttttatgaaaaattaggttttaaacctcaacaaactcaaatggaggagatactataatgaaagaaacacaagaagaattacgtcagcgtattggacatacagcttatcaagtaacccaaaattcagctacggaacatgcttttactgggaagtatgatgatttttttgaagaggggatatatgtagatatcgtcagtggagaggttttattctcttctttagataaatttcaatctggttgtggttggccagcattttcaaaaccaattgagaatcgaatggtgacaaatcatcaagatcactctcatggaatgcatcgtattgaggttaggagtcgtcaagctgactctcatttagggcatgtatttaatgatggaccggttgatgcaggtggtttacgctattgtatcaattcagctgccttagattttattccttatgaccagatggcaaagagaggctatggggactacctatcactttttgattaataagagacgacttaagggtatatcttaagtcgttttttatgtatggtaaaaagaattggtggcaggtgtattcttcatcagtttattttctgaaaaaagagtataatataggtatcaaaaatgaaaacgttttagagaaggagactagaatatggcttctacaaataatgtttcagatacaaacacacgttttgctaaagaggagttagaagaggttttcgaagaattagggacaactcaaggtggtttatcagatgaagaggttgctgtacgtcagaaaaaatatggtttaaacctgttatctgaagtaaagcaagaatcgattattttattgtttctgaaaaattttactagtcttatggcaatactattatgggttggaggatttgtggctattgtttctaatagcttagagctaggtcttgccatttggatggttaatgtgattaatggtatttttagtttcattcaggaataccgtgcaagccaagcaacacaagctctcgagaaaatgttaccatcttattcacgtgttcttagaaaaggctcagaagaaaagatattatcagagcaactagtcccaggcgatattgttcttattgaagaaggagaccgtatttcagcagatggtcgcttgattaaaacaacagatttgcaagtaaaccaatcagccttgacaggggaatcaaatcctatttataaagatagcaatgttgaaaacgaccagtctaaaacattgattgaatgtgataatatggttttcgcaggaacgacggtctccagtggtagcgcaacaatggttgttacggcaattggaatgcaaactcaatttggtcaaatcgctgatttaacacaagggatgaaatcagaaaaaagccctcttcaaagagaacttgatcggttgaccaaacagatttctatcatttcaattacggtaggaattatctttttcttagcagcgactttttttgttaaggagccagtgtcaaaatcatttatctttgccttggggatgatcgttgcatttatcccagaaggtttactacctaccgttacactttctctagctatggcagtccaacgaatggctaaagaacacgcacttgtcaaaaaactttcttcagttgagactcttggagcaacctcagttatctgttctgataagactggtacattaacgcaaaatgaaatgaccgtcaatcatttgtggcaaaatggaaagagttaccaagtgacaggactgggttatgctccagaaggacagattctttttgaaggtgacaatatttgctttggtaatagtgatagaggagacttagaaaaacttattcgttttgctcatctctgtagcaacgctcaagtattaccaccaaatgatgatcgttcaacttatactgtacttggagatccgacagaagcttgtttgaatgttttattggaaaaatcagggataaacatacaagaaaatcgtaagtttgcaccacgtttgaaagaattaccttttgattcggttagaaaacgcatgacaactattcatagcttaggaggcgatgaaaaggataaaaaaatttcaattacaaaaggtgcgccgaaagaaatacttgatttatcagattatgtcttatctgatggcaaagttatccccttaaacaaggaagaacgtaataaaatacagttggctaacgatacatttgctaaagatggacttcgcgtcttagctgtttcatactgcgatattgaaggcttttcaaaagaacaatggacgcaagaaaatttggaacaacacatggtgtttatagggttgatagcaatgagtgatccacctcgtgaaggcgttcgcgaagctattgataaatgtcatgcagcaagcattcgtattattatggtgactggagattacggattaacggcactaagtatcgctaaaaatattggtattattcgtaacgatgatgctaaagtaatttcaggtttagagttatcagaaatgacggatagccaattgaaaaaagaattgtcaggtgaagtcgtttttgctcgtgtagcaccagaacaaaaatatcgagtagtaacgatattacaggagatgggtgaagtagtagcagttacaggagacggggtcaatgatgcgcctgcgctaaaaaaatccgatattggtgtagccatgggtgttaccggtactgatgttgctaaagaatcagctgatatgattctgacagatgatcattttgcttctattgtacatgctgtggaagaaggacgggctgtttatcaaaacattaagaaattcttgacgtatatttttaatagtaatactcctgaggctgttccgtcggcattcttccttttttctaaaggttttattcctttaccattgactgtaatgcaaatacttgctgttgatttgggaaccgatatgcttcccgctttaggtctgggcgtggaaccaccagaaacagacgttatgaatcgtcctccaagacggctaacagatcgcttattggacaaagggctacttataaaatctttcctttggtacggcactattgaatccgtattagctatgggtggttttttctgggctcattacttacgttatggtaattttacttttttcgtcgcaaacggcataccgtacagagaagcgacaactatgacacttggagctattatctttagccagataggtatggttatgaatagcagaacgagctatcaatctattaaagcactatctatttttggtaataaattaattaattttggtataataatggagattttagcatttttagtcttagtatacgtgccactattccataacttattcaacacagcaagcctaggtttatcacattggctctatttaataagctgcccatttatcatgataggtttagatgaagttcggaaattattcagcagtagaaagaataaacggtgatgtcaaatataataacttatttaaaaaataattcaaacttaacttttgatgaattagcattaaacgatgttgacattctttgtttaaatgaatttggctatatttcttttgaaaaacttataaacactacagaaatgaagtcagttttagtctgtgagttatatcatgagtaccttcaaactatggctaaatcatatagctttatgttcacatcacaacgacatgatttatgtcagttaatgatgacctcgaaacgttttaaaaacttaactttatcttattatcgagctgagattagtttagaatttgaaaaacaatttgcagctatggtttttactattcctaacattaattatcatcaggttgtatttcgtggtactgatgccaaccttattggttggaaagaagattttaaattgacttatatgagagaaatatcggctcatcgttcagcgattaaatacttaaatacaatactgccttattttgataaagtagttctctcaggtcattctaaggggggtaatttagccttgtacgctgcaatgtttacaaagccagatttaaaagcaaaaattgatttgatttggcttattgactccccaggactacaaaaaactttgttacctactacagagtataaaactactaaacaaaagtgcattcgcttactaccagaagaatctattgttggtatgatgctttatagtgatatagagccgctaattattagtagcaatgcgcgtggaattctgcaacacgatgttacaacttgggaaattcaagaaccagctattttaaagactggaacaggactatcgctaaaaagtatttgttttgaaaagacatttcaacagtggatggctgaattaaaaagtcaagaaagaaaattattttttgatttattatttgatagcttcctatcaagtggcgtatctagtttggatgacttcaacttggcttccagagcaaaaatgatgaaagcttttcatagctttagagaactagatgatgataaaaaaaggttatttaacaaatctttaaaattattagtaaccatattttggggagcttatcatgataatagcagagagactaagtagctttcctagaattgcattagtctaaacatggtgctaaataaactagcaaaatagcacactaaaaatactactcatattatgctgagtagtatttttagtgtgctatttgatgaagttattctagagtttatgatttttgttttcggaaatactttttagagtattgaagaattccttcttatctgaaaattcgctaatatgttccttaatagcttcatctgaccaattccaccactgagatgcatttaataatgttatttcttcctctgaaaagcgatatttgataattttagcaggtgttccagcgacaacagcatagtcaggaatgtctttggtaataactgaacctgctccaataattgctccattacctattgtaacagatggaagtatagtgacattagttcctatccagacatcgttgccaataataacttttccatttttcttttcatctattaagtccgccctatcctcatttataaatccccttgacttatagtaaataaaagggttagtggtaatgtgatcggttggatgattcagaccagtaatagtaacgttctgggctattgagcaaaatgctccaatttcttttaagttaacgccttcgtaaaagaattgttgatatccatatgtgtactttcctaccgagaatccatatttagggtaactggcaccagtactcatatctgtcctcataggatcatttttaagctctaaacgtttctctaaatgtttttttaaaatactagccataactagcctccaatcgtagactaaatagattataacattttttcctctaaaaaccttaccttttttaataaattctataaattagaatgataaagaacttattctcggatattgacaaagagtgagctaatgaggtggcctaattcaatgttagagtctgttcccagtatttttttcctaagatagaggcaatgtatgaacaaagaaacatacttaaaaccttgtaataacaaggttttaagtatgtatagtaagttatggtaaaatgatatggagccggtgggagtcgaacccacgtccaaacatctgctaatatatttgtctacaactataggttatgtattgatttaactaggtgatgacacataactcaagccctcacatagcgagtctataaatctctttttaactaactagacagtagccaaacgtagtttgctgataaataagaccttctagcaaaacgcaaacaatcttgtgaagatcacgcaggctgttttttaggcagctaatgcgtaagaatttgtattttttgcagttatatttaactggcattttacatctgccgatgagtcgcgaaatatacctcataatgcctgtcgaatccgtaacgaccccaaaagtagaataaagcataaaaacttaccaatatagtataacaaatactatttaaaatagcaaaaatttaacagttgtgttatgattaaagcatgaatatgaaattatcaaaacgttaccgcttttggcagaaggttattaaggctttgggtgtcttagcgttaatagcgactcttgtcttagttgtttatttgtacaaacttggtattttgaatgatagcaatgaattaaaagacctagtacacaagtatgaattttggggtccaatgatttttattgtggctcaaattgtacagattgtttttccagtaattcctggaggtgttacaacagtagcaggtttcttaatttttggtcctaccttaggctttatttataactatattgggattatcatcggaagtgtcatccttttttggttagtcaaattttatggacgaaaattcgttttgctatttatggatcagaagacatttgataaatatgagtctaagctagaaacatccggatatgaaaagttttttatcttttgtatggcatctcccatttcaccagcggacatcatggtgatgattaccggtctatctaatatgtctattaagcgctttgtgacaatcattatgataacgaaacctatttctatcatcggttatagctatttgtggatttatggcggtgatattttgaaaaattttttgaattaaaacaaagtataaatttctaattatctttttatattttcttaaatgctcgtaaagccttattctatgtgctttcgagtatttttactgtaggaagatacttcacgtttctttgcatatttcctcatgtcttagctgtcagaagtggtaaataagtagtaaattcatttgtactactaagcaacaagacgctcctgttgcttctctttattcaagcgtttcatttctgccattgcagaatcgaatgttgcatgtgcgtaatagttcagcgtcatggctatattagcatgtcccataatgtactgtaatgcctttggattcattcctgcatttgcatagttggtacagaatgtatgtcgcaaactatgtggagtgatgtgtggcaatttatcctcgttatacttattgtatttcttaacaagacctttcatcatgccgttgtaatcacttgccacttttggatagttctttctattaagaaagaggaaatcactatatccatcaatctcaacacgcttatcattctttcgattcgctaacactcgcttaaatgcttgataggcttcttcaaccataggaacttgacgttcgccacttttggtctttggtgtttcaatgtagtacccaatttcagtatctctcaatagctgatggtctatattgacaagacgattctcaaaatctaaatctggaagtgtcaaaccaccaaactctgaaatacgaagacctgtttttaagagtatcagaatttcatcataatttttgctgtaggttttatcagcttttgcaaaggctaacagtttttcttcctgttcttctgttagtacggtcttagggacagtatcatcatcaagaactgctttcagttgaaagtcaaatggattcttccgaacacaatcatcttgtatagcaatatagaatgaagcctttaaagaacgtttgtagttattgatggtttgataagcataaccattttcactcattctaatagcccattctttagcgtctgatggcttaatactgtcaatacttcttacacctaacttgtctttcttcaaaatatccataagatatttgcgtccagtttcagtgttttttctaacctttggtctttgagcgttctgttttgcgtaaagctggcagagtgtcattttctttcctacaacatcaataccatcatgaatgtctttctgtaactctgcgattttctctctaagtgagatacaatcacgctttcctgctggtactcggtctgtagccacaagtttccacgagtaaacaaattgcggttctccaaatgaatctatatatttgtataagtatcttccgtcttttcgttggctctctccagtctttaagattcgacctttattgtcacgtcttttttctgacatggcatttgctcctttcctttatggaaagagccttgatacgacttaatactattttatcatatacaagaccctttggcgacgctagattgcgtccaatgtatctataattttttcaaattgttttcgtttaatctgaatacgattgccattcataatcagccaatttgcatttttattttcctctgccaagcgtcgtagcttgttttcgccaatacgaaaatattttgacgcttcttcaatggttagggtataacgttcccaaataggaatgtcagtctgcttcataaaatcctcctttccaaatcacttatttggatttcataaaagttgttttaccagcaatcgaacagctttagcaaagctcacgggagttccacccctgcatggttctcatgtagccatactcattgcctgcgacggttttatcacgctcggactattgactgtatgggagtatcattatcacgataagaatgtcgttgcaggcaatcctgctaaagattgcttctcggatcactaacatgaatcgctcgctatctttataagataggtcatggcggttagttccgttggctcttttcttatcgaaacgtattcgattacttttattcagttttcaaagaacaatggctcgttagcctatcaaaacacattgaaagctcaatatgctttggtggaataacaaacctccctgttcgggaagcgtggaatggtttagcacgcttccacgaaaggagagaggatattacttaatttcaaatgacaaaatctttgtaatcagtctggtttccattcttccacgtaagacttcatcaacgaccatactttgattgccatattcatctttcataagtcgtagggaacgcttcgttatgtaccctctgtaatgatgtagaatctggttaatcgcttcggtatcgccatctgttgcctttacaatgagaggaaagggaatcataggatattgtgttttcattcttcaaattcctccataaactttttaattaaggctagtccactggttctatgccgatagacagtagaacggttcaatttcaacaggtctgcaatttctgaatcgctcatgtccataaagtaaaacagcagtagaatttcacgtttcttgtctggcaactcacgtaatgcttcactcaacaaatcattttcaacgcctactgataacccattgagtgtaaaaatctgaaagtcagttgaatagttatctgttgtcgcaaactggctaacaagataatcgccaacatccgaaaaggacacctcacgctttgcaatccttgaaagataaagcatataattctttcgctcgtcttccatagcacgtttacagatatagtcaaactgattttctattgtggtctgaaaagaagatggtttcatgtttctcaccccctttctgtctaggaaaggaagtgagccttgctcgtttatctcctttcactcttagtcccaatgtgaaagggggatttgttgcattactgataaataaactttgtaaaaaagttctgaatagccaaaaaagcatataaacagatttatttctctgtttacatgcttctgttattctatctatatgatttataaaaccacattggtggacgtacttatctattgcagatagacgactttttttgacaataacccaatgtaaggaaatttattgtatatgatgtacttcatggcgacgttgacctccaacaaaccgccatttggaagtaatatacaatattttaacagcgtaaatagcactaccatataacggttttttttattggcgtttagtagtgctttttattaaatataaacctataaaccatataacacgtttttctatacctgtttttaattcagtaggaacaataaaatgtatagaggtggtctactatgcgtaaaaaagaagataaatatgattttagagcctttggtttagccattaaagaagctcgattgaaacgaggtttaactcgtgaacaagtgggagcattgattgaaattgacccacggtacttaactaatattgaaaataaagggcaacaccccagcatacaagttctttatgaccttgtatcgttacttcatgtttccgttgatgaatttttcttacctgctaataacttggtaaaaagcacccgacgattacagatagagaaatacatggatagctttacagacaaagaactatccttaatggaatctttagccagcggtatcaacgaagcaagaaacatcgaagactaattaaaagaatccatacataacggaaagagccgataaaatgagattgtattaatctcattttatcggctctgcgtctttgcgtctggctctgtaatcacagttactttgaactgctttatttcaattaaattttcttgtctgcatttcggacaatagagggggaatttttttaattcagtatcttcccttatctttaatcgtgttttatttccacatacaggacacaatatccacttgtagtttataataactatctcctcctttacactttaattcaaatctttattaaaaaatatttcatcttatttaacaagaaaccatatttatataacaacataaaatacactaagttattttattgaacatatatcgtactttatctatccgactatttggacgacggggctggcaaacaggttcaccggtagtaacatggtacccttttaactctgttaaacaaacactacgtccatttgtaaagaaagttaaatcactacgatattcttgaatacaccgagcagggatttctccactaagaatgacctcattatttttcaattgagtgtctacgatgttcgcacaatatttaggagcatcgttgtatgctcgtgaaagatattcctgtggcgcataaattttaaaactaagatatggctctaacaattctgttccagctttttttaagacttgttccaatacaataggagcaagcatccgaaaatctgctggggtactaacagggctatagtataagccatacttaaaacagattttacaatccgtcacattccaaccatataatccttgttcgcaaccatagcgtatcccttccataactgcattttgaaatgattgatttaagtatccaagagaaaccgagctctcatactgcattccacttcccaacggaagcggtgatacagataaaccaatggaagcccagaaaggatttggcggcacttcgatgtgaatggtatattctgcattttttaacggtctctccatataaatgactgtaggctcttttagttctatctccacatgatacttttcttgcaacagtgcactaatcacttccatttgtactttccctaagaaagaaagtataatttcatgtgtcgtagaatccacgtaatatcgtagaagcggatcactatctgagatttccaaaagggcatcaagcaacatttctctctgttcaggtttactcggttcaacagttgtttgtagtagagggtgcggattttcaatcttttttctctgtggcaatagttttgtatctccaagaacactatttaacttcaaaaactcattttgcaaaataacaatttctccagaataagctctatcaatcttacataattcaccatttattgaagtatacatttctgtaacttttattttttctttttctgatactctaaccgaatctcgtaaatgtagtactccactataaaggcgtatatatgcaagacgttgtcttttttttgtatattcaattttgaaaacatttccgcaaagttcagacggacctcgatgtgttgatgaataaaatttattcgtaatcacttctataaggttatcaatccctatattgttttttgcacttccgtgataaacagggaacagggaacaattatgaaatcttatgctttcctcttgttcgagttccaatgcttctaatgatttaccggacatatatttctctaaaaggtcatcgtttccctctattaccgtatcccattgttcagattcggtaaagttcgtcacacacatattaggatacagttctaccttctgtttgattacaatttcggcagaaagtttctctttaatatcctgataaaccgttgataaatcaattccattttggtcaatcttattgataaaaaagattgtgggaatccccattttcctaagtgcatgaaataatatacgagtttgtgcttgtacgccatcttttgcagaaatcagtagaattgccccatctaaaactgataatgaacgatatacttctgctaagaaatccatatgtcctggcgtgtctatgatgttcaccttcgtattttcccactgaaaagaggttattcctgtctgaattgtaattcctctctgacgttctaaaagcgtattatccgtcctcgttgtacctttgtccacgcttcctaattctgtaatcgctccactgttatataataagctttctgttaaggtagtttttcctgcatcaacatgagctaaaactccaatattaataattttcatgtgattttcctccattcaaaaacccaaaagggcataaaaatcccagtgataaatacttttatcactgggatttttatgcataaccataggtatacaaagcatacagatattctctggatactttagaatcacatgataaaggtattcttaaactgggtacaaaaaactaagccctcctaaaaaaggacatctaattatttgttcccgctatcaaattgacagtttatttaagaataccttgccgcatatttattaactccttttaaatagtcacttaaataatagcacgtaagagcatatttgtaaaggaatctccaattttttatcaaaaagagtacatgattacaaagtatctgtaatcatgtaccaatatttgttattttacaatcttccaattactcccgttcttttcaagtaccaaatcaaattgagatacctgcgttgctttggtctgctggtcgatatactccactgtcagcgataccgtgacttgattatccttacgattgtgaataggatttaccagttcttgaaagatgtactcttttccgattggttttaatatcccgtcattcacatagtaggaaagttcactggctgtcgctgtaggatagagcttgaagaacgtcgttaaaaactcattgatttcattggttgtaatggaatcaaccgtcccctcactttcaatggcttttggtttataacttgatttcttaggtatgttggtaatggtcggattcttaaccagtaccatatttccagaaccatctacatagacactcactatataagcagagtggacggtctttgtattttctccctctgtaatgagctggtctacactgtaggttacattaaactcattgtcgccagttggctctaccgtccatatctgaaatcctcttacagaagacgatacaggaatatctttgcgtactgtatcaacattgagagcttgaagttcatctgtcagatagccttttagactttccattcgattatcaatggacttatcggattgctcccatgaatagtagactttcgcaaagttctctacaaaattttctacatgatgagtatcaacgtattccttttctatgatagttgtttcgtgaatagtatgagtatctatagctgtaaagtgcttgaatatcgcaaagctgaaactaagccctaaaagtacccacaaggcaatcacaacctttttatgaggattgaccttatagacacgaggtttcttttcctttggtatctgtttttctttattctgattttttctaaatttcatcattaaatcttcctttctcattgtttgattcgtcctgctcccactaaatgctgttgccagtaggggcttgttaagtcggcataaccgattgggtcgcctgcatgaaacatacggttattgccaaggtatatcccaacatgagtaatataagagccagcgttataggtagaatgaaagaaaaccaaatcgccagcttgtgcttccgatagtgggatatgctgggtcacatcatattgctgttgtgcggttcgtggtaagttaattccagcttttccatacgtccattgtgtcagtccgctacaatcaaaagaagtagtcggggaagctccaccgtaaacgtatcgccagccctcatatttcagtgcttcgtccatgatggcttgtaccgtatcatcatcaaactctgttgtgacaagatactgcgttaccagttgcacataaaacatattgccatagttgtatcgccagcccccattgataggtatggctatgggattggggtaagacactttttcgccacctgaatactcttttgagaaactttgagccagttcaaaggtatatttatttccacgattagccacataccctaagaaaccaccaccataattgtaggactggataaccgattctaaatctacactgagcctttcgctactggctaataattcactgaaatacttcacaccttgcttaatggattcttctgtactcaatgaattaggtggaagaccgagggattccgaggactgcataacatcttccgcagtaccgcccgattccacctgtataatcgcaagaagtatgttgacatattcttcaacgccatattctttggcatatttttctaccataggcttatgagccagcacttctgcggaaacattcacacctccataatgaatattggaaattccgctgtcctgttcatctgaaaataaaatggcaacaaacagaagcagtgagaagaccatcaagaataatccagaaccaccaatcactaaagttttcaacttcatggtttcttaccgactttcttaatggtggcggttttgattggtggtctacttcttgtattttgtagtggtactctttgaacagtagacggacgttcttttgtgattggacgttgtgaagttctatctgctgtagtggttgaagttgctggcttttgaacggttttttcttgaacggtattgccttggcgttccacttttggacttgaaaaatcggacttaactgctggacgctcttgtttggcttgttgagattccttatatgaagtctgaatattagactgttttgaggtctgttcatcatgatattgttcttgtcttgtagtcggtctttcatgaacagaagaagcaggctgttttttctgtttgacctgttccatttcagagcgacgcttcgcaatggtttttcgcctttgttcctgctgttccttgcgtccactggctctgtccgctttggtttgagaaatactactggttaaatcacggacattctcttttactttggattttccttgatatactgcatatcttgcattggtcggcaaatctttaacctgttctttcaaaccactagcagtgtctaccattctgtctttggtatcagctactgtaccgatggtttgaccgatacgttttccaagtgttgatttttcctttccgtctggtcgggagtgatctgcttgtgtccttgcagaactccccgaacccgactgtccttttttacctgtaacaatggcagacccagcccctagagtagtcatggaacgtccaagtttccgctgtagacggtgcatgtgagcgtgcataagcatacgaggttttctcatcacacgacttcccacactttgagaatcgttactctgtagagaaaacatactcattaaatcgcccagcttgaagtagattcctgcaaaggtcacaatctgtagaaaagcaatcaaaaagaacggataaccagccgataaggtatagagcatggttgaaatactaaatgctgtcgtaataatcaatgtgattccagctcgtgtcaaaatggtattaaagagctttgttatggctcgttttgacataccatcaaatgatggaatcatgcttaaaataaagctcacaggcagaaacatagcatagatgataaaaagtacctgcgagaaaatcatgattcctgttaataggaatacaaatatggaaatcccaatattgaagacaaataggaagaagactgtacctaaacggttaatggtctttgtaatggttagattggtattgcttctgtcttcaatttcttccgcaacaattttttctctgtcttcgccattgttggaatctgggctggtggagagcaggctttccacacggtcaataccgatactttcaatgtctgaactgttgtattgaagcagtagccacggttgctgaacctgtatggaaaacaggctatctctgattaagtccacgctgtccttgccttgactatcggaatggggcatgacaatcttcgtgccaagtgataaactggcattactgatgtctgatgaaaagtcattgatttttttaatgtagtcgggagcgtaggcaataaaggaagccgataggataaacaccagcacaaaattcataatggcatgaattgcctttgtggtttctctctttatcagtcccgtataggcaacataaaccccaagaaccaaaatcaagagtaagaggaatccaacatagaaaccctctgttgaaaatccgtttgcactcacaccagctaaggtctgcatattcttaccaatggaatctgctgtagcggaaatgaagtctaaggaataggcttcctgtactaagtaacctgtcgcattggaaacatacaaactgattgtccaaataaaattggtaatggcatatagtccatacatgacctgttttccaatcccgtccgaccagttccacggaagccagccccagctattatccacataaaaatccagttgatagttttcaagtgggtatcggctgtattcatttgccacattgaccgtatcatctaccaagcccgcagcttgaaccaccgttcccagcatggctaaaagaaaaatggcaatcacaagtgtgaaagccactgtcattgccactttacctagacgtttcagcgtccagtttgattttattctgtttactattgatggtttcacatttacacctcttttcgcacaggtggtctggtatcaaaggcatggagcagttcttcaaatacagggtggaactgtatcacaccgacacgaccatataaatcactgataaggcattgcccgttttccaaatcacgcaatcgcttctgattgttttcgtcctctgggtctacaccaaaaaaggctaaggtctttttaatctcgttaaggtcagtggaacgaaatgcaaattttaagccgaggttatttttcagtttttcatctaagaggtcgtctgtattttgggtcacgaaatataccccagcgttcatagcacgaccagcccgaaccagcttcatagatagtgtttttccttgtgctacctgtaaaaagctccatgcttcgtctaaatctacaatcttgaaaatgcttcggtctgtatggataaagtctaaagcaaaggtactaatgacaatcagcatagcaacggataaaagctccatagtggtatattcctcaaaggaagtttccttgtcgggaagtaccaagtccgcaacctgtataatgttcagttgtttttctaagctgatagactgctccacataaccattactgaataataaatgtgcaaagtcatagtctgtaaaactttcgatatggtcggctatactggtacttagtggcgtattctcaacccgtaattcctcaatcactttcatcaaccctcgtacttcactattggttactgcacgaatggcttttctaaggattgggaagcgttccccatcacgagaggaaatccccgtaaggaatgtcagaatatcaatagccagtgattcagaatctttgggatttttcataatcacataagggtcaagtaagcctttgtttttctcatcagaagtcagagtgacgatattgatttcatgggaaatctctggcaaggtttctttccatctgccacgttctgcttttgggtctacaatcactgcttgtgccccataaagcaccgcataatagacgataaggttattcgcaaaggatttaccaccacccagcgaaccaacaaaagccgacgctaacgcattggttactgaacccttaaccccttgactggcaagagcaggtttcagatagacattgcgtccagtatctaagctgtagccaacataaatcccctcattttcccccagcatttgagtagcaccaaaacctaaaccagcgaggaaatcagaggtcacgtattgaatataatcattcatataacgcttgctggcaggtaaaaattcttcatgtaagccgagcatatccccaaatggtcgtaccagttttacgcttaaatcgtcataaaaatctttcacttcattacaacgacgtttgagttcgtcaagatcatttgctgatacccttaccacataagacagcttgtacatagattccttgctttggtctaaattggtttccagctcattcacactttccagagcttccgccacattggagctggtttcattatcactttgccaagcgtggttatccaagtctttcagttctttctttttttgcggacagtagatagggctttacgattcgctacaatttccacattcattgacgtatcaatcgggaatgtaaattgctgttgctggtagtagaagatttcagaggacgggaagtccagttctccgacaatgctgttaatggtaaagtaagctacatagacggtttcatcttcctgctggattttcaaatatcgctgtttttcttccaccaaacagcgagtaggcttaatcaagtcatagtatttaatcagcgtttcattatccagctttttctttgatagatggtactcatactcttcataggcagtgcctgtctgtccgtaaaggtgttcaatcagatagccgaagtcgtccttatctaacctgcggattttgaaacgacgagagattttattttctaagagcttttccatcttctgaaaacgcaggatttcatcattactcatactaacaaaatcgcccatcagcttatggttcacatcatagacaaaatcagacaaagcattttttgcttcaacggtaagacttttcatagaaaactcctgatcgttgagaagcaacttaaagccgataaagaaacggtagttcacttgattttcgccaatcatggatattaaagcgtctgtctgttggtcgattttgtcataggcaaccgctttgagcttgccagtgacttcatttttggaacgctcttgtgcagaacgtatgctggattctgtactgatttgtaaagcatgaattttgccatcacgattttgtgcgataagctgtctgaaagaatcatgcacttgtattttctgttctggacttagaaatgagtaattgtaaggaacaagctcatagtaagcataacattccccgtctttattccagacgagattgttttcaatgtatttaattggatatgccataaaattcactcctaactgctgtaatggcttcttgtggctggtttctgccaagcgttactttttttcctgcataggtcagctttggtcgcagtgcataagcaatgacagacttcaaaaatccataaggctttttaccatcaaaagtttttgtagacataaaccatgtgaaagccacaggaatcccaaagtatttgagaaatgctccctctatcatggaaagagggggcaagttgccaagtatcatcactgcaaagagtgacacgacaaaccatgtcatttgcgtaaaggttatgggaaacggaagtctaaaatcattgatagaatacagtaccttttccacagaccagatactggtatagcttcgtattttcttcatgtaatcaatcctttcataaaaaataggggtagctgattgagccaccccgtaaaatagaaaatctgccagtagtaatgtaccgacagatttaatagacgatttcaaaaatcccatgattggttgagataaacgttcctgaaaggtctaaatcccgaccataggcttgataatcaatatagttttgaagactagctggtacttcgcctaaagcacccgtttcttcaatgtagtagcgtgccacgtcatacatatcatcacaatcggaatgaatgataatatcctcttgatgttcgcttagttcttcaatgcttgaaaaatgagtgagcagagcagatagctccgattgtaattcttcgggtaattccgataccatttcccatagtcgattgagttcgccaatggaagtgtattcgtcaaccgtaaagggtaactcgtagtcatgaatggcgtattcctcatattcatcattcaagccgattttctctttgacttcctcaaagtcaatgggaaaggtaaaccacgcaccgaccaattcgccctcattgtatttgcctaaattcgcaatatagacttgcatatcgtccatatattcacgtcctttctttgtagagattcaaaaatccctaccgcacttcgtttggtgtaccattcctttgcggaacataagaaaaccacttatattccacaaaagaacggttttatttaagcaccaataatgcgattgaatagctctagtaaaatgtcttttactccagcagcgttgaagactaagccaaccgcaataatcgcaataattaaaaagccaatcagtttgctaaactcacgcttgaagccaagatacaagccaatcacaacgattgctaaaagcaccagtgattgagcgtttgatagaaaccagttataaaggttttgtccaaaattcataaaaatgttctcctctctatattcaatgaatttgtatttgagttatttttttgttgttatcacgtcctgttcttttactgactgttgcttcaaaatctgcttgtgtcggtctgtcagtttcgcatggtcgagaatgtcttttacaacctgcgtctggttgatttcatcaagtttaatcgcaacctttaaggtcggggcaacttgatgagatagccagttcagcgtcctttggaaggagtaaggctctggttttgtggttagttttaatcgttcacgattgttcccaataaaccaagcccattcttcattcagtttccaatcagaacgaggtttggaatcgtctttatctacaaaacggatataccgattgataattttaaaggcggtatgctctggattgtcatagacgagtaaatcacggactgcataataggcacgctcatttttcaatcgaatctcaaaacggttttttacttctgcgtcttcaatgggaatatcatttttcttgtactgctcgtagtccttttcatagatacagaaataaacttcactttgtaatgaaccgatatagagggtgtttcccatacattccttttcctctttgcgtaccagttcgccactgcgatagcttttaaaactgcggaagacggagatacattcttcctgttggcacttttcagtgagtacagggatatttaaaatccctgtcttatcgttaatggcaaggtcaaggcgtttcatcacaccgccagccaccaaaacgtccataaagaactcataccagcttctttgttgtgccagaagatagctttcaaattgtctgcacccacgacctttcaattccaccagaactcctttgtccagttcatgggagcaaaggacgaatatgtcgcctaaagcataatgctctgaataagaatagaaaccatagtcctcatgaagaaaataggacagtttcagttgtaagatgttttcgaccacctgctgtacgtctgttgtcggaaagcgaattcttacataatcaaacagcatttcaaggggagcgtcgggattgaagcgttccagagcttcccaaagggactgctgtaaatcctctgatggcttgacttttcctgtttcaatatcgcttagatactgccttgtaataccagtcgcaacagctaaacggttttgagatagtccataagccaagcgtttttcttttaaatgctgtaaccaagtttgttcattcagtaaaaatccctccaatcaaaaaggcgtatgtcaacttttaaagcccatttgacatacgctgaaattttgtaaatcccttgtaaccaaaggattttctaatgtttttttgactgtttcctgtcgatttgtacccccctgttagatacggggggttaagtgctggcgtggctattgccacaccagccagcaagatcagtccacacctgcgacttccgcttcgcacgtcgcctgcgtggactgtctgctgttggataactttttaatttcctccaagaaatcatatccttttggtacaaggggagtataaaactctgatatgacacttgttcctacatcaacatagccacgacctttgattcgctttaagaagaaatccttttgtacgtcactgccaaacatcatgccatagcccatttcagacatacgacctaaagccactctgaaattaaactgatcacggattccgtcgcctaaatattttgcgtctggacgttgacaagccagtattagaaagaagccagcttgacgacctaacatgacaatctgtttcagcttattcataactgcggtgttttcttttgttcccagcatttccatgaaagcgacgtattcatcaaagattaagaagtgtgccgggagacctaagtaagcataatttttgccagtcttatagttcttcatctgcttcatttcctcactacgtttcatcatttcttcatagaatgtttcaatgcaagaaagcaagtcttcttttctatagtagacatttgccatcacagaacctaagtccgcaagatcagcatttttcgggtcaagaatatacagttttgaatctgtatgaagcaaggcttcaatcagtgtcagtataaagtaagttttaccgccacctgtaccaccagcaatcaacatatgagggagcttatcatattcccaccatacgtttttcattaagcgaagtttaccatctttagcttctacttcatcaatagaaatacgactggctatggtgtcatagagcaaagtatattccacataggaatcctttaactctttatccgtcagctcacagtacaagccactctctaatttcttttccaagtgtaagagttggtcttgatattttcccagcgtgatttccacccgtatctgtatcaagccatttttaagtcgataatacattttagggaagtaggttatcttttcctttgtacgaccagcactatctttaaagaaaccctctgttttgacctgttcagattcataccacttgttttcaagtatcatctttgccagtttttgacggtggtaaagttgtttaaccgtatcatagcgaacccgtttgaatacaaacgctaccagcaagcagataagaattgcgacactgaaactgataattaaatagggaatgtcaatcttatctgcttgtgataggttaaaatcctgccagttgatctgctggattgtcttcacatgaaacagtccgacaaccagcaggaaaacaggcaggagtgacgctatcgtaaaatgaaagactaaatctttaccagatgggcgaatccttttaccacgctgtttcatgcgaaaaagtctcctttctacctagcgactatttgtcttgtgtcggttctttctttgcttgtggttgagctttgaatgaactagaatcctttgtcagcacaatatcgtctgccttgatataccagtcaacatctgctccttgataggtggcagtagcaacggtgtccgcaatgggattgataagttccacccgtgcgttataatcaaactctttcaaaggcacgctggcaggaatacttacttgaatcatgcgtccttgtcctttggattttaagtcataggtacgttccttgatttcatctgaaaccgacccgtcttcattttggattctcacttcacgacgtagagcagagaatttcaattctccaaaagtcgtgtctttatctaatacaatgccatttgctaatctcatcatttttcctctctttctttattcttttatcatgtcgtcagcatgtaaaaggtaatttgtaaaaccacgagtgccgattttgtagccctctgcggtaatacgtggattgactaacttcacacgttcctcaaagccgaaatgtttttcgccagcttcagcaggaagcaccaccacaatatcatctgctctttgaacatcagaatagagattatagcttcttgataagacagttagccgtccgttgattcttcgctgaacgactttatcctcgccagcaaattctaaattgccgaatgttttttccatgttgggaatcacaaatttaagttccatatttttacctatcctttcttttttattggctgaatgaatgtttgatggtcttaaagagtggggaacgaccttttgattcttgattttttgttttcataagttcacttcctttcaaaatcgggtaaaaaaatagacacctcattttttgaagtgtctacctattaaatattcaaattttattggaagtatctttatatcttcacttttcaaggataaatcgtcgtatcaaagctcattcataagtagtaaattagtagtaaattgagtggttttgaccttgataaagtgtgataagtccagtttttatgcggataactagatttttatgctatttttatttataaaaataaaaaaaggttggagatatatctccaatctttttattgtatattaagtttgtacttaataatagagtgtgtcaacatatagaatatagcaatttcaacaatgctaacaagtatattgtagagcaatacaggttgagagaatgttgcatttgcatgagagttgaataaatcaatatgaaaaatactatctattattaatgttaagaaagtaattaagagtgatattccaaaataagaaacaattcccatcaatacacgtttgtttgtaaataattgccctacagcgatagagagataaatcagtaatgtccctgcaacgtacgatagaaagaaataggcgataaaaagtggagcgttcgaagatgaaataattttatagatttctggaaaagcgacaacgaactgaccaatacctactaaaggtaatatgaccaatatgattccaataatgacaataaaaatattaaaaatactccaaagaagagaagctagtagctttgaacaaataatctgattcgtagttactgggagcgttaaggttagatatccttgacggccgaagatattgctataaaaacgtttgataataatagcaagggtggataacagagatcctgaaataaccatcgctaacaataaaacgagtattatagtgaatatttgggcgctagtactattagtatcagtagaaaaattgccgccaagtgcctttaataccagtcctaaaataatagatactaataaaaccgcagcgttgagtgttagataccacttaccaactgattttaattcatattttaataattttccaaacatatcaatctcctttatttcttgaatctttcacgaaagagagcatcaatcgaacagttgtgctcttctcttaagtcatcagcattgccttgtaggtcaatttctccttctttaaggaagataacttcatcaaggataggttcaatgtcagaaattaagtgagtcgaaattaaaacagaagcatcattagagtagttgctaatgattgtttttaaaatgtagtcacgcgctgcagggtctacaccaccaataggttcatcaaggatgtagagcctagctttacgactcataacaagtattaattgaactttttccttgttcccttttgataggttttttagacgttccctaggatttaggttaagatcctcaaatagttgatatgctacctttgaatcaaaatcgttatagaaatcttcaaataatgtaacgacgtctttgattttcatattttcttgtaaatatgaagtatcagggagatatgaaataatttttttggtttcaacagacggtctgtaaccatcaataacgatatctcccttatctggctgaagtaatccatttatcattttgatgattgttgtttttccgctaccatttggacctaataaacctataatctttcctgttggaatacttacagtcacatcattaacagcagtatgtttgtgatatttctttgtaacatgatgaagttgtaataactgtgtcatttaattaatctcctttataaaatgatcgagagcaaccgtaatttcatctaatttatatcctatttttttcatgttgttgacaaaagttgctaactctgcttttgcaacttgttgacgaattttaccaattagtaagttgtcttctgtaacaaagcgtccggaagtacgttgtgagaataccattccttcacgttccaattcagtgaaggcacgttgcatggtatttgggttaacaccagcttcttgagctaactctctcacggtaggcaattggtcaccactttttatttcttgactaacaatttgcatctttatatgttcagcaatttgtgaataaataggtgatttttcattgaattcccaagccatagataactcctttcataatcttgtactttttgtactataaaaatagtacaaaaaaatatttgaaatgtcaaggaattatcattgagactttaatcgtttattgtttcatagtataatagtaaaaaatcgtaaaaaggggctactatgtttgcacaacttgatacaagaaccgtttattcttttatggatagcttggttgatttaaagacatatgtctctaaatcgaaatcattaggatatcaaactattggtatcttggaccacagtaatctttatgcagcatatcattttattcaagaggcgcaaaaggcaaacctaagaccaatagttggatttagctttgatatagtggttgaaaatagatcaatagaagtttactgtattgcgataaatacagttggttataagaatctcttgaagttgtcaacggctcaaatgtctgagaagatgtctctaaatttattgacagaacatcttgaaggggtgcaattgattcttccctatcaagatgttcttgatcagctcaatttaccctttgattatgttattggtgttaatttgacctctccgcagattccatataccaaacccattatagccatagatactgttcgatattttcaaaaaaatgatattgagacattacagatgcttcatgctataagagataatgtcctgttaaaagacgcacaatatgcgagcaaaaatcaagaattaaaaccttgtcaagaaatgactctagcattcaaggaacgttttcctgaagctttagctaacctagaatctttggtagagaatgttgcttatcactttgattctgactttaagttacctatttttaatagagaaattcctgctggagaagaattaagaaccttaactcaaaataacttaaaaagtaaaggtttatggagcgatgcttatcaagagcgtctcgaaaaagaattaacaatcattcacaaaatgggctttgatgactatttccttattgtgtgggatttattaagatttggtcgtagtaagggctactatatgggaatgggacgtggttcagcagcgggaagtttagtctcatatgctttaaatattaccggtatcgatcctgtcaaacataatttaatttttgaacgttttttaaatgaagagcgttattcgatgccagatattgatattgatcttccggatatttatcgtggagaattcttgcgctatgtacgtaatcgatatggttcaatgcattctgcacagattgtaaccttctcaacttttggtgcgaaacaggctattcgagatgtttttaaacgctttggtgcatcagagtatgagttaacaaacataactaaaaaaattcatttcagagataatttgaccagtgtttataaccgcaacttagctttcagacaaataatagatagtaaaattgaataccaaaaagcctatgatattgctaagcgtattgaaggaaatcctagacagacttctattcatgccgctggggtagtaatgagtgacgatttgttaacagatcatattcctttaaaaaacggtgaggatatgatgataacgcaatatgatgctagttctgttgaggataatggtcttctaaaaatggactttctaggtcttcgaaatttgacatttgttcagaaaatgaaggagaaagtcgataaggactacggtatctctatacaattagaaactattgatttagaagataaagagactctaaaactatttgcagctggtcaaacaaaggggatttttcaatttgagcaaagtggagctattaatttgttgcgacgtattaggccagagtgttttgaagatgtggtagctaccaccagcttgaataggcctggtgcaagtgattatactgagaattttataaaccgtcgttttggtaaagaaaaaatcgatttagtagatcctgtcatagctccaattttacaacctacctatggcataatgctctatcaagaacaggttatgcagattgcccagacctacgcaggttttacgctaggcaagtctgatttgctcagacgtgctatgtctaagaaaaattctaaggagatgcaaaagatgtctcaatccttcttagagggtgcagtatctaagggacatcgtcaagaagatgctcgacttatatttgaacgcatggctaaatttgcaggttatgggtttaatcgcagccatgcgtttgcttattcggctttagcttttcaattagcctatttcaaagcccattattccgatgtcttttatgacatcatgataaattattcaaatagtgattatctaatcgatgctattgattttggttttgttattgaaaaaccttcaattaatactatttcatacagagaccgcatctataaaaagaaaatttatttaggtttaaaaaatattaagggtgttcctaacgatttggcttattggatttctaaaaatcaaccgtttcagagtattgaagattttctaatgaggctgccacagcagtttcaaaaaagtggttttatttctccgctaattgctattggagcatttgacgaatttgataataatagacggaaaatcacctctaatcttgattctttatttacatttgtaaatgaactaggtagtttatttgcagatacctcatatcattggctagaagtagaagatttctctaattctgagaaatatgaaatggaacaagatatcttaggagtaggaatcagcccgcaccctttagtggggatttcacaaaaagctagccgtccgtttataccaattagtcaagttcaagaaaatagcgaagctactattttagttcagctaaagcaggtcaaagttattaggacaaaaagttctgggcaacaaatggctttcttgactgttatggatattaattcaaaaatggatattactgtttttcctgaaactttcaatattgtaagagatgatttacaagaagggaaatattattacttgcatggaaaaattcagaagcgagatgagcgattacagatggttttaaacggtgttcaagaagcaacggaggaacgtttttggatacttctaaaaaatcatgataacgacaaaaaaatatcggaaatattgtccaaatacaaagggcatattcctgtctatttgcattatgaaacaactaaagaaactatccaaagcaaagtacatttggttagaaaagatagtggcttagcccttgatttatctgaatttgttgtgaaaacggtttatcaataaaattgcatataaagtgcagaaatttacaaattaatatgctataattaaatcgttaaattaataaaaggagtaccaattaaatgaaacgtattgctgttttaactagtggtggtgacgcccctggtatgaacgctgctatccgtgcagttgttcgtaaagcaatttctgaaggtatggaagtttacggcatcaaccaaggttactatggtatggtgacaggggatattttccctttggatgctaattctgttggggatactatcaaccgtggaggaacgtttttacgttcagcacgttatcctgaatttgctgaacttgaaggtcagcttaaagggattgaacagcttaaaaaacacggtattgaaggtgtagtagttatcggtggtgatggttcttatcatggtgctatgcgtctaactgagcacggtttcccagctgttggtttgccgggtacaattgataacgatatcgttggcactgactatactattggttttgacacagcagttgcgacagcagttgagaatcttgaccgtcttcgtgatacatcagcaagtcataaccgtacttttgttgttgaggttatgggaagaaatgcaggagatatcgctctttggtcaggtatcgctgcaggtgcagatcaaattattgttcctgaagaagagttcaatattgatgaagttgtctcaaatgttagagctggctatgcagctggtaaacatcaccaaatcatcgtccttgcagaaggtgttatgagtggtgatgagtttgcaaaaacaatgaaagcagcaggagacgatagcgatcttcgtgtgacgaatttaggacatctgctccgtggtggtagtccgacggctcgtgatcgtgtcttagcatctcgtatgggagcgtacgctgttcaattgttgaaagaaggtcgtggtggtttagccgttggtgtccacaacgaagaaatggttgaaagtccaattttaggtttagcagaagaaggtgctttgttcagcttgactgatgaaggaaaaatcgttgttaataatccgcataaagcggaccttcgcttggcagcacttaatcgtgaccttgccaaccaaagtagtaaataagaatttgtcaatttgacactttaaataaaaaggagctcataaattattatgaataaacgcgtaaaaatcgttgcaacacttggtcctgcggttgaattccgtggtggtaagaagtttggtgagtctggatactggggtgaaagccttgacgtagaagcttcagcagaaaaaattgctcaattgattaaagaaggtgctaacgttttccgtttcaacttctcacatggagatcatgctgagcaaggagctcgtatggctactgttcgtaaagcagaagagattgcaggacaaaaagttggcttcctccttgatactaaaggacctgaaattcgtacagaactttttgaagatggtgcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacacgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtaacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggatttgttgaatcaggcgataatatcgttatcgttgcaggtgttcctgtaggtacaggtggaactaacacaatgcgtgttcgtactgttaaataatttttgaattcaaacctattatttaagaataccttaaataatgggttttttatatgttttgctttttattattcgattattgtgactagaataggatatgatattaataattaccctcctttttttatctatgaaaacatgatataatggaaaaaagattaggagtagttatggttaaacgcgattttattagaaatattattttagcattgattgctgtattgattttgattctcttgagatattttgtttttgcaacctttaaagtacataaggatgctacaaattcttattttagcaacggagatgttgttgttgttaatcgtaataggacgcctaagtacaaagactttattgtctataaggttggaaagattttctatattagtcgtgttattggtgagccaaatcaaaaagtgagagtaatggatgatattttatatttgaatgatgttttcaaggatgagccttacattgaaaaaatgaaaaatgcttattctgaaaagaaagacggtcaaatgccctttacttccgacttctcagttgaaacattaacacgaaataaagaaagcagagttcctaagggttcttatcttgtgttaaatgataatcgacaaaataaaaatgatagtcgaaaatttggattaatcaaagagaaagatattcgtggtgttattacctttaaagtataccctctaagtgaatttggttttacagcttcagagtagtaaaagaatggtattatttgataccattctttttatgtaataaaatggctaagaaatatatttttttaagatagatagaatttttgatagcgtttatctcgttatcacagaaaatcaaaaagactataccaatttttttattgacaaacaaaaacattaattatatactgtttttgttactttttaacggtatatattaatatataccaattcaaaaagaaagtttagatagaaagtataagagaaagctcttattggtaataataatatgtgtggtatcgtaggtgtagttggaaatacaaatgcaacggatattttaattcaaggcttagaaaagctagagtaccgaggatatgactcagcaggtatttttgtagtaggtgataacaaaagtcaacttgtgaagtcagtcggtcgaatcgcggagattcaggcaaaagtaggagattctgttagtggtacgacaggtatcggtcatacacgttgggcaacccatggtaaacctactgaaggaaatgcacatcctcacacttcaggatctggtcgttttgtattggtacacaatggtgttattgaaaattaccttcaaattaaagaaacttacttaacaaaacataacctcaagggtgaaactgatacagaaatagctattcatttagttgaacactttgttgaagaagataacttatcagtgcttgaagcctttaaaaaagccttacatattatagaaggatcatacgcatttgctcttattgattctcaagatgctgatacgatttacgtagctaaaaataaatcacctcttctaataggtttgggaaatggttataatatggtgtgttcagatgccatggctatgatacgtgagacaagtgaatatatggaaatccacgataaagaactcgttattgttaaaaaagatagcgttgaagttcaagattatgatggtaatgtcattgaacgtggtagctacacagcagagcttgacttatcagatattggtaaggggacttatccattctacatgcttaaagaaattgatgagcaaccaactgtgatgcgtaagttgatttcaacttatgcgaacgaatctggagatatgaatgtggattctgatattataaaatcagtccaagaagcagatcgtctttacatattggctgcaggaacgtcatatcatgctggttttgctgctaagaccatgatcgaaaaattaactgatacacctgttgaacttggagtttcttcagaatggggttacaacatgccacttttgagtaagaagccaatgtttattttacttagtcaatcgggagaaacagcagatagtagacaagttttagttaaagcaaacgaaatgggaatccctagtttaactataacaaatgtgcctggctcaacactttctcgtgaagcaacctatacgatgctcattcatgcaggacctgaaatcgctgttgcttctacaaaagcatatactgctcaagttgcaacgttagctttcttagcaaaagcggtaggagaagcaaatggtaaggcagaagcaaaagattttgatttggttcatgaattgtcaattgtagcacaatcaattgaagcgaccttatcagaaaaagatgttatctctgagaaggtagagcagttgttaatctcgacacgtaatgccttctacattggtcgtggtaacgactattatgttacaatggaggctgcactgaagctaaaagagatttcttatattcagacagaaggttttgctgcaggtgaattaaaacatggtacaatttcgttgattgaagacaatactcctgttattgctttaatatctgctgattcaactattgcagcgcatactcgtggaaatatccaagaagttgtttctcgcggagcaaatgctttgattattgtagaagaagggttggaacgtgaaggtgatgatattattgttaataaagttcacccattcttatcagccatttcaatggttattccgactcaattaattgcttactatgcttcattacaacgtggcttagatgttgataaaccacgtaatttggcaaaagctgtaactgttgaatagactcgttacactaaaatacgctaatattaactacaaaatattaaaaattgtaaaaaagcctatttttgaaggaaaataggccacgccaaacgcatgaagaaacttttgttttcagaaaactagattcataatgacaaaatcaatcaaagtagtacactatagatgaggtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggctaagcagatcattgatttaaaaaggaatcttttcaaaattgatgtccgggcacaaaaggatgaagagaaagttttcatgcgtacggcgtggaaaataggctttttcctattgtcaagaagcctataatcagttagaatgttacttgctgactattttattaattaatttaaggagagaaaaatgtcattaccaaattgccctaagtgtaactctgaatatgtctatgaagacggtattttactggtttgtccagaatgtgcttacgagtggaatccagaagaaatcgaagaagaagtaggtttaattgtattggatagcaatggaacgcgcttatcagatggagatactgtgacagttattaaggatttaaaagtaaaaggagcgcctaaggatattaagcaaggcactcgtgttaaaaatattcgtttagttgatggcgatcataatatcgattgtaaaattgatggttttggagctatgaaactaaaatctgagtttgtaaaaaaatagctttcaggcaattggcaacggtcaattgctttttgaatatgacttgatttcatgcatttttattaaaaaagctctatgacattggtttgaattttgatataatgagaacatctattttttatttaggggggaccatgtcttatattttagaaatcttacctagcttattagtaggtgcgcaagtgacattgcaagttttctttattgttatttgtttatcaattccacttggtattgttgtagccttcctaatgaaagttcattttaagccgcttcaatggctactgacaacttatatttggattatgcgaggcacgcctctgttattacagcttatctttttttattactttttaccaagtgtagggatttcttttgatcgtatgccagctgcgattattgcttttacgatgaattatgcagcttattttgcagagatttttcgaggaggtattgagtctattcctaaagggcaatatgaagctgcaaaggtattaaagttttctaagtttcaaacggtttggtacatagtattacctcaagtcttcaaaatagtcttaccgagtgttttcaatgaaacgattactttagtgaaagattcctcattggtttacatacttggtgtgggcgacttacttctagaaagtaagacagccgcaaatagggatgcaacacttgcaccaatgtttatagcaggtggtatttacctattattaattggtcttttaactattttatctaaacaagttgaaaagcgttttaactactataaataaggagggacgatgttagaattaaaaaatatttctaaatgctatgggcaaaaagaaatctttaaagatttcaatctgactgtagaagaaggtaaaattctctctttagtaggaccttctggaggtggaaaaacaacactattacgtatgttagctggattggaaaagattgattcagggactattgttcacgatggtaaagaagtatctgttgatcatttggaaacactaaatcttttaggattcgtcttccaagactttcaattattcccacatttaacagtattagataatttgatcctctctcctgttaaaacgatgggattatcaaaagaacttgctaaagaaaaagccttagtattacttgaacgcttgggacttaaagaccatgctttagtctatccattttcattatctggggggcaaaagcaacgtgtcgcactagctcgtgcgatgatgattgatccacagattattggttatgatgagccaactagcgctcttgatccagagttgcgtcaagaagtagaaaaactaattttacaaaatagagaaacaggtatgacacaaattgtagtaacacatgatcttcaatttgctgaaagtatatctgatacgattctcaaaattaatcctaagtagacttgggggtagattgttgactcacaaaaatatattattaaccattatatttggattatttatgattatattatcagcatgtggtatgtctaataaggaaatggctggtattgataattgggaacattatcaaaaggaaaagaaaattactattggatttgataatacttttgttcctatgggatttgaaagtcgttctggtgactataccggctttgatattgatttagctaatgctgtttttaaagaatacggtatttcagtgaaatggcagcctattaactgggatatgaaagaaactgaacttaataatggtaatatagaccttatttggaatggttattcaaaaacggcagaacgtgctaaaaaagtcgcttttacaaacccatatatgaataatcatcaagtaattgttactaaaacttcatcacatattaatagtattaaggatatgaaggggaaaaaactaggagcccagtcgggttcatctggttttgatgcttttaacgctaaacctgatattttaaaaaagtttgtaaaaggaaaagaagcagttcaatacgatactttcactcaggctttgattgatttaaaaaataaccgtattgatggtcttttgattgatgaagtttatgctaactattatttaaagcaagaaggaaatataaaagcttattattttgttaaaactgcttatcaaggagaaaattttgtagtaggagctcgtaaagttgatcgtagactaattgaaaagattaacaaagctttcaaacagcttcataataaggggagatttcaaaaaatctcttacaaatggtttggtgaagatgtttatagtaaagaataaaagactaggaatttctcctagtcttttattctacgaaaaaattaaataaaaaacatcgatatatccgatgttttctaggttaattaaccaagtttagttgcaagacgtgctttatcgcggcttgctttgtttgtgtgaattaaacctttagaagcagctttgtcgatgcttgaagaagcagcgcggtaaagttcttctgaagggttagcttcaaatgctttaatagcagtacgcatagctgatttttgtgctgagtttttttcgttttgtttaacgttaagttcagcgcgtttgatagctgatttaatatttgccaatgttttcacctccatattaatctaactatataagtatatctaattaagtgatttttggcaaccctttatcactttttgagataaatttcatcaattttatgatgtttccctttatgaataataaaatcagccctatttctggttggttctatatatttttcaaggttgactaaattaatagttttccaaatatctttagctagttccatagctttatgtggcggtatttgtgtgaatttatgatagtaattactagggtctgcttcggctaattgtagaagactgttaaatcgttgtaaataccattcttcaatttgtttattttcagcatcaatgtatattgaaaaatcaaaataatcattcatgtaaagtcgatggttttgttggttttgaaagacatttattccttctaaaattaaaaaatctggtgtttcaatagtttgcaattgatttggaacgatatcgtagatttcatgagaataaattgggattttcgcggttataccgttctttatagtatctaagaaatttagaagtgactccatatcataggattccgggaaacctttacggtttaaaattccattttgtatgagtttctcgttaggatataaaaagccatcagtagtgactaattcgacgtgactatctttaaaagttcgtgaaattagtaattgtagtaagcgactggtagttgattttccaacagcaactgaccctgatatgccgataataaaaggacgttgataattttcctttttaagaaatattgctttagaaaaagataaattttcttgactacgtttatagatttgaataaggttaattaaaggaaggtagatgtcaataacatcttgaatattaatattatcgtttaagcttttgatagattcaagctctttttcagttagtaaagcttgggattgctgatgtaagtccttccaattttctctggaaatacggtcgaaattaataaattcattattcatgtcaaactcctatatgaaagctattataacattttattgagtgattgaaaaccgtttcaaaatatggtaaaataatatggcgaaattggagggttagaattatttatggctaatatgtattatacagagaatcctaatgttgaacatgatattcatgagctaaatgtcaaattattaggagaatcattcagttttttaactgatgcaggagttttctctaaaagaatgatagattatggtagtcaagtccttctaaatagtttacattttgaaaaaaataaatccttgttagaccttgggtgtggatacggtccgctgggaatttctctagccaaagtgcaaggagttaaagcaactatggttgacattaatacgagagcattggaattagctaagaaaaatgcaacacgcaatggagtagtagttgaagtctttcagtcaaacatttatgaaaatatttctaaaactttcgactatattataagcaacccacctattcgtgctggaaagcaagttgttcattctattatcgaagaaagtatctgttaccttaatacaggcggtagccttaccattgtcattcaaaagaaacaaggcgctccaagtgcaaaagctaaaatgctagatacttttggtaattgcgatattttaaaaaaagataagggatattatatattgagaagtgaaaaagtctaaatgatatccctaaagcgtaaaaataataaatagttcggataataactatcgtattattttttggaaaggttttctctaaaaatgttttctttaaattccgtataagataaaaagaattctgctttttattctgaaaattataaaaaactacttacattatctaaaaaaaatggtaaaatagattcagctaaaataccaagactaatgaaactacaagacttggttactcaataataaatacttctgtgtttgataagaagataataaacgtgttctaaaaattttgccagtaaacattatgaagcgaaaggtgcagctactaaaaatgggaaatatagagttgaaaaaattggctgtaaaagcgagtgaaaatgcatacgttccttactcgaaatttccagtaggcgcagcattgcgtacagcagaaggaaaaatatttacaggatgtaacgttgaaaatatcagttatggattagcaaactgtgctgagcgtactgcaatttttaaagctgtttcagaaggttataaagatttttcggaaattgctatttatggaaatactgaagaaccaatttctccttgcggtgcatgccgtcaagtgatggtggaattttttaataagaatgctaaagttacattgattgctaaaaatggtaagacggtcgagacgacggtcggtgagttgttaccatactcgtttgttgatttaaaataatttaaatcagttgctcttttaagcatttagcttaaatattaagttttttaggagggttcatttcatgaacaaaaaaattgccgggatcggcttggcttcgattgcagtacttagtttagctgcatgtggacatcgtggtgcttctaaatctggtggtaaatcagatagcttgaaggttgcaatggtaacagataccggtggtgttgatgataaatcatttaaccaatctggttgggaaggtatgcaagcttggggcaagaagaatggccttaaaaaaggagctggttttgactatttccaatcggcaagtgaatctgattatgcaactaacttagatacagctgtgtctagtggttataaattgattttcggtattggattttctcttcatgatgctattgataaagcagcagacaataacaaagatgttaattacgtcatcgttgatgatgttattaaagggaaagataatgttgcaagtgttgtctttgcggataatgaatcagcttacttagcaggtattgcagccgctaaaactaccaaaacaaaaacagttggctttgtaggtggtatggaatctgaggttattacccgttttgaaaaaggttttgaagcaggtgtcaaatcagttgataaatcaattaaaattaaagttgactatgctggttcattcggtgatgctgctaagggtaagacaattgcagccgcacaatatgcttctggcgcagatattgtttatcaagtagctggtggaactggtgcaggtgtattcagtgaagcaaaatcacgcaatgaatctttaaaagaagctgacaaagtttgggtattaggtgtagaccgtgaccaagcagcagaaggtaagtatacttctaaagatggtaaggcttctaactttgttttggcttcatcaattaaagaagttggaaaatcagttgaattgattgctactaaaacaagtaaaggtaaattcccaggtggtaatgtaacaacttatggtttgaaggatggtggagttgatatagcaactacaaacctttcagatgacgccgttaaagcgattaaagaggctaaagctaaaattatttcaggagatatcaaagttcctagcaaataatatctttaagaactttcaaaaaagcgattagaaatcgcttttttgaagctgagataaacttatatctcagtaaaatccatcagtcgttaacgattggtggattttactgaactataaatgaatttttctgaaagggagaaccacatgacacagaatgtcattgaaatgaaagaaatcactaagaaattcggtgattttgtggcaaatgatcatatcaatttgacggttgaaaaaggtgagatacatgctctgcttggcgaaaacggtgcagggaaatcaactttaatgaacatgttagcaggtttactagaaccaacagacggtcaaatttttattaatggtcagcctgtaactattgattcaccttccaaatcgtcacaattggggattggtatggtacatcagcatttcatgcttgttgaagcatttactgtagctgaaaatattgttctaggaaatgaaaccacccaaaatggtgttttagacattaagacagcagctaaagaaataaaggaactatcagagaaatatggtttgtcagtaaatccaaatgctaaaatatctgatatttctgtaggagcacagcagcgtgttgaaattttgaagacactttatcgcggtgcagatattttaatttttgatgagccgacggcggtgcttacaccatcagaaataaaagaattgatgacaattatgaagagccttgttaaagaaggcaaatccattatactaattacccataaattggatgaaattcgggcagttgctgataaagttactgtgattcgccgtggtaaaagtattgaaacagtccctgttgcaggcgcaagttctcaacaactggcggaaatgatggttggacgatctgtttccttcagaactgaaaaaaaggaagctaatccgactgacataatcctttctgtaaaggatttagttgtagaagaaaatagaggcggcgttctagctgttaaaaatctgtcgttagatgttcgagcaggtgaaattgtaggtatagctggtattgatggtaatggacaaagtgaattaattcaagctattacaggtttaagaaaggtaacttctggtcaaattgtaattaaaggtaaagatgtcacaaaattttcaagtcgacaaattacagaattaagtgtaggtcatgttccagaagatcgtcatagagatggtttggttctagatatgacgatggcagaaaatttagctttacaaacttattataaagagccattgagtcataaaggtatccttaattttgctaaaattaaagagtatgctcgtcaattaatgacagaatttgatgtgcgtggtgctggtgaacatgttttagcaagaggattttctggtggtaaccaacaaaaagcaattattgctcgtgaagtggatcgcgatccagacctactcattgttagccaaccgactcgtggtctagatgttggtgctatcgagtatattcataaacgtttgattgaagagcgcgataaagggaaagcggtcttagtagttagctttgagttagatgaaatcttaaacttatcagatcgtattgcagttattcatgatggtaaaattcaaggaattgttaaacccgaccaaaccaacaagcaagaattgggtattttgatggctggtggaaaaattgaaaaggaggagagagatgtctaagaaggcgcaaaaaattgcagttcctctgatttcagttgtactaggaatcattctaggagctattattatgctgatatttggttatgatccactttggggttatgagggattgttccaaacagcattcggtagtataaaaaatattggtgaaattttccgtgcaatgggaccattaattttaattgctctaggtttctcagttgccagtcgtgcaggtttctttaatattggacttccagggcaagccttatcaggatggattgccgcaggttggttcgctctttcacacccagatatgccacgtccagcaatgattctttgtactattattattggtatcgttgctgggggaatcactggagctattccaggtattctcagagcataccttggaacaagtgaagttattgtaactattatgatgaactatattgttctttattcaggaaatgctattgtacaacgtgttttcccaaaaagcattatgcgtacaagtgactcgagtgtatatgtttctgccaatgcatcataccagacagattggttatctagtttaacgaataattcacgtatcaatattggtatcttcattgctattattgcagttgtgttagtttggttcctattaaataaaacaacgcttggatttgaaattcgttcagttggtttaaatccaaatgctagtgagtacgctggtatgtctgcaaagcgtacaattattctatcaatgattatttctggagcttttgcaggacttggtggtgttgttgaaggactaggtacatttgagaatgtatttgtacagccatcctcgttagctattggctttgacggtatggcagtaagtctactcgcagcgaatagtccaataggtattttatttgcagcatttctatttggtgttctaagtgttggtgcgcctggtatgaacattgcaggtattccacctgagttaattaaagttgtaacagcttcaatcatcttcttcgtaggtgtccattacattattgagtatgttattaaacctaaaaaacaaatgaaaggtggtaagtaaattgagtttaacaacgatttttgcattgctattttcatcaatgctaatttacgcaacacctcttatctttacaagtattgggggaaccttctctgaacgtggtggtatcgtcaacgttggtttagaaggaattatggtaattggagctttctcaggcgttgtatttaatttagagtttgcttctgtttttggtgatgcgactccatggatttctgtactagttggtggtttagttggtttaattttttctgttatccatgcagttgcgacagttaattttcgtgcagatcatattatcagcggaaccgttcttaatttaatggcaccttcattagctgttttcttgattaaggttctttataataaaggtcaaactgataatattcaagaatcatttggaaaatttaatttccctatactatcagatattccttttgttggtgatatcttctttaaaggaacaagcttagtcggttatattgctattcttttctcattccttgcttggtttattctatataaaactcgctttggattaagattacgctcagttggagaacatcctcaagcagcagacaccttaggtattaatgtttatcttatgcgttactctggtgtcttgatttcaggtttccttggtggaataggaggagctgtatatgctcaatctatttctgttaactttgcagcgacaactatattaggaccgggctttatctccttagcggcgatgatttttggtaagtggaatccaattggtgcaatgcttgctagtctattctttggtttatcgcaaagtttagcagttatcggtagccatttaccacttttgagcaatattccaacagtttatctacaaattgctccatatgtcctcactatcattgtattagcagctttctttggacaagcagtagctcctaaggcggatggtattaattatattaaaacgaaataaataaaaagaaactagtataagctagtttctttttattgtttgtgaatttgtgaaaaaatactttgtgaaaatttcacataaattataatacaataacaataaaatataaaaaaatagaaaattgagtcattattctagtaagagtttgtgaataatgttataatgtgttttgttattaattatttataaaggagaactcttaatatgagtaaaatcgttgtcgtagggacaaaccacgctggtacagcagcaattaaaacaatgcttagtaattatggtgaagccaatgaaattgtaacatttgatcaaaattccaatatctctttcttaggatgtggtatggctctttggattggtgaacagattgatggtccagaaggattgttctactctgataaagagcagttggaaagtatgggagctaaggtttacatgaactctccagtacttaatattgactacgataaaaaagaagttacagctttagtagatggaaaagaacatgttgaaagttatgaaaaacttattttagcaactggttcacaacctatcattccaccaattaaaggtgttgaaattcaagaaggatctcgtgaatttaaagctactcttgaaaaccttcaatttgtgaaactttatcaaaattcagaagaagttattgaaaagttagctaaacctggtatcaatcgtgttgctgttgttggggctgggtatattggtgtagaattagcagaagctttccaacgtattggaaaagaagtaacacttgttgatgttgctgatacttgtatgggtggttactatgatcgtgactttactgatatgatgagtaaaaaccttgaagaccatggtattcgtcttgctttcggacaagctgttcaagcagttgaaggtgatggtaaagtagaacgtcttgttactgataaagaaacatttgatgttgatatggtgatcttagctgttggattccgtccaaatacagaactcggtgcaggtaaattagatacattccgtaatggcgcttgggtagttgataagaagcaagaaacaagcgtgaaagatgtttatgctataggtgattgtgcgacaatttgggataattctcgtgatgatatcaattatattgctcttgcttcaaacgccgttcgtactggtattgtagcagctcacaatgcatgtggtacagagcttgaaggtgctggtgtccaagggtcaaatggtatctcaatctatggccttaacatggtgtcaactggtttgactttagaaaaagcaaaacaagctgggtacaatgcagttgaaacaggctttaatgaccttcaaaaaccagaatttatcaaacacaataatcatgaagtagctattaagattgtctatgataaagatagccgagttatccttggttgccaaatggtctcacacgaagatgtatctatgggaattcatatgttctcacttgctattcaagaaaaagttactattgaaaagcttgctttgaccgatatcttcttcttaccacattttaataagccatataactatattacaatggctgcattaggcgctaaagattaatttaaaattaaaaaggttaagcgaaatgcttagccttttatttcatcctttaacaaggtcaaaaatgtaacggcaaagaaaaagctaagatattcctatcctagctttttttcaactatgttagttttttgatgcttcttggaattctgggtttttccaagcttcgtcaataatatcttttaattgttcagctgaggcttgcattttttgaagttcagcatcatttaatgggatattaactggacgaacgataccatgtgcacctacgattgcaggctgaccgataaagacatctttaacatcaccgtattggccttcttgatatacagataatggaagaactgcattttcatcatcaaggatagctttagtaatacgagcaagtgcgacagcaataccgtaatatgtagcaccttttttgttgatgattgagtatgcagcgtcacgaactgaaataaacaaatcaacaagtccttgttcatcaatatcgcgattttcttgtaaccattgttcaagttggacaccagcaacgttagcatgtgaccaaacggcaaattctgagtcaccgtgttcacccatgatgtatgcgtgaactgaacgagcatcaacaccaattttatctgctaaagcttgacggaaacgtgcagagtcaagtgaagtacctgaaccaataacgcgttccttagggaaacctgagaatttccaagttgaatatgtaagtacatctacagggttagccgctactaagaagataccgttgaaacctgattcaacaacttgagttacgattgatttgttaattgctaagtttttaccaacaaggtcaagtcgagtttcacctggtttttgaggtgcgccagcagtaatgacaacaaggtcagcatctgcgcagtctgcataagtagctgcgtagatttttttaggtgatgtaaatgcaagggcatgtgaaagatcttcagcatcaccaacagctttatcaaataaagctgggatttcaatgatacctaactcttgcgcaataccttggttaacaagtgcaaaagcgtaagaagaacctacggcaccatcaccaacgagaataacttttttatgttgtttagttgcagtcatttctaaacatctccttaaatatttttgggaagtttcccatacacctatattctatcattttcaatgaaagaagtcactaataaaatgtgaaaaaatttgcaaacaaattgaaatatcatagaaaactattgaaaacgctgagtgtcttgatatttttgataccgatttatcatcgcaattttacctaaattatggtacaatgtaagagacttacagtgaagaaaaggggcattttttaatgcaagataaaaatttagtagatgttaatctaactagtgaaatgaaaacgagttttatcgattacgccatgagtgtcattgttgctcgtgcacttccagatgttagagatggtttaaaacctgttcatcgtcgtattttatatggtatgaatgaactaggtgtgacacctgataaacctcataagaaatcagcacgtattactggtgatgttatgggtaaataccatccacatggtgattcatctatttacgaagcaatggtgcgtatggcacaatggtggtcatatcgtcatatgctcgttgatggtcatggaaactttggttcaatggatggggatggtgctgccgcacagcgttatacagaagcacgtatgagtaaaattgctcttgagatgcttcgtgatatcaataaaaatacagttgattttcaagataactatgatggcagtgaacgtgaacctcttgttttaccagcgcgtttccctaatttattagtcaatggtgcaactggtattgctgtaggtatggcaacaaatattccaccacataatctaggtgagtctatagatgctgtcaaattggttatggataaccctgatgttactacacgggagttaatggaagttattcctggtccagattttcctactggtgccttggtgatgggacgttcaggtattcaccgtgcctatgaaactgggaagggatcaattgtcttacgttcacggactgaaattgaaacaacttcaaatgggaaagagcgtattgttgtcacagagtttccatatggcgttaataaaacaaaagtacacgagcatattgtacgtttagcacaagaaaagcgcattgaaggtattactgctgttcgtgatgaatcaagtcgtgaaggcgttcgttttgttattgaagttcgtcgtgctgcttcagcaaatgtgattttaaataatcttttcaaattaactagcttgcagacaaattttagcttcaatatgcttgctattgaaaaaggtgttccaaaaattttgtcattacgacaaatcattgataactatattgaacaccaaaaggaagttattgttcgtcgtactcagtttgacaaagctaaagcaggagcccgtgctcatatcttagaaggtttacttgtggcgcttgatcacttggatgaagttatcacaattattcgtaatagtgagacagacaccattgctcaagcagagttgatgtcacgttttgaattatcggagcgtcagagtcaagctattttagatatgcgtcttcgtcgtttaactggattagaacgcgataaaatccaatcagaatacaatgacttactagctttaattgctgatttagcagatatcttagctaagcctgaacgtgttgttaccattataaaagaagagatggatgaggttaagcgtaagtatgctgatgcccgtcgtacagaattaatgattggtgaagttttatcacttgaagatgaagaccttattgaggaagaagatgttcttattactctctcaaacaagggatatatcaagcgtctcgctcaagatgagtttagagcacaaaaacgtggaggacgcggtattcaagggactggagttaataacgatgattttgttcgtgaattggtttcaacaagtactcacgatactgtgcttttctttacaaatttagggcgtgtgtatcgtttgaaagcatatgaaattccagaatatggacgtacagctaaaggcctccctatcgttaaccttttaaaacttgacgaaggtgagacaattcaaacaattattaacgctagaaaagaagatgtcgctaataaatatttctttttcacaactcagcaaggtatagtgaaacgtacaagtgtttctgaatttagtaacattcgtcaaaatggacttcgtgctattaatttgaaagagaatgacgagttgattaacgtcctcttgattgacgaaaatgaagatgttattatcgggacacgtacaggctactctgttcgcttcaaagtgaacgctgtacgtaatatgggacgcacagcgactggggtacgaggcgttaatcttcgtgaaggtgataaagttgtgggagcttctcgtatcgttaatggacaagaagtactaatcatcactgaaaaaggttatggcaagagaacagaagcttcggaatatcctacaaaaggccgtggtggtaaaggaataaaaaccgctaatattactgctaaaaatgggccattagcacgcttagtgacgattaatggaaatgaggacatcatggtcattacagatacaggtgttattattcgaaccaatgttgctaatatttctcaaactggtcgttctaccatgggtgttaaagtgatgagacttgatcaagaagctaaaatcgtcactgttgcgctagtggaacaagaaattgaagataagtctaatatagaggatacaaaagaataggaagttatgcgtaataaaaaaaaatcacatggtttctttaactttgttagatggttattggttgtattgctaattattgttgggttggctttggtgttcaataaaccaattcgcaatgctttcatagctcatcaatcaaatcattatcaaatttcacgagttagtaaaaaaacaattgaaaaaaataagaaatctaaaacaagttatgacttttcatcagtcaaatctattagtacagaatcgattttatctgctcaaacgaaatcacataatttgcctgtaataggagggattgctataccagatgtcgaaatcaatctcccaattttcaaaggactgggcaatacagagttgagttatggtgcaggaacgatgaaagaaaaccagattatgggaggcccaaataactatgccttagctagtcaccatgtctttggtttgacaggttcttctaagatgctcttttcacctttagaacatgctaagaaaggtatgaaagtttacctcactgataaaagcaaagtatacacttacactattactgaaatttcaaaggtaacaccagaacatgttgaggttattgatgatacacctggcaagagccaactcactttagtgacctgtacggatccagaagccacagaacgtattattgtgcatgctgaattagaaaaaacaggtgaattttcaacagcagatgagtcgatattaaaagcattttcgaaaaaatataatcaaattaatctctagaaggtagttagaattatgaaattaaaggctgttcatcatattgcgataattgtttctgactatgaaaagtcaaaagacttctatgttaataagctaggatttgaaattattcgtgaaaaccatcgtccggagcgtcatgattataaattagatttacggtgcggtgatattgagcttgaaatatttggaaatcgtcttgatgatccagaatatgaaactcctcctcagagaataggtaggccgaattggccacgtgaagcatgtggtttacgacaccttgccttttacgttccagatgtggaagcgtacaaggtagaactggagaatttaggaatttttgtagagcctattcgttacgatgactatactggcaaaaagatgacctttttctttgatccagatggtttacctttagaattacatgaataataaacaaagttgcgtggatacgcaactttgtttaatttactgaataattttatattcaagaagttttttaaagaaataagtaagttaatcatggtataatgtaaggtatgaaaagaattgaaaaggaattattttgaaatgaggatactaaaatgagtattaaaaagctattgtttgcaggccttgcttttattttatttaccctagcgagtccagcatatgctgcatcagatgttcagaaagttattgatgaaacttatgttcaacctgattatgtcttaggttattcgctaaatcaagaacagcgtgcacagacattacaacttctgaattatgatgaatctagagacacgaaagttaaaacgctaaatactagctcatatgctaaaataatgaatatagctgatgatgcaagcatccaattatattcatctgttaaaataaaaaaattagggtctaacgataccttagcagtaaacattgttacacctgagaatattactaaagttacagaagatatgtatcgcaatgctgcagttacattaggtattgagcatgcaacgatatcagtggctgctccaataaaagtaactggggagagtgctcttgcaggtatctattattcattagagaaaaatggagcaagtgtatcatcagaaaataaacaactagcacaagaagagttaagtactttatctggtattaatgctgagaataagggtaaggaaggttatgacgccgacaagcttaatgtagctttaacggatattaagtcagccgtagctaaaggaggatctgatctttcaaaagatgatattcgaaaaattgttgaggaaacattgaaaaattatcatcttgataacgctgtaacggaaaatcaaataaatttaattgttaattttgcagttaatctttcacaaagtaatgtcatcaaaaatagtgatttcacgaacaccttgaataatttgaaagacaacattgtttcgaaagcaggatctaaatttaaaaatatcaatgtcaattttaatgctaataaagctgttgaatcaggtaagggatttttagctaatatttggcaacaaattgttaattttttccagcagtttggtagttaataaaaaagtctagcttataagctagactttttttaccctaaataaatgtttgtgtttttttactaatctttaaatgaatatttaagaataaatggcgcaataatagttgatagtataacaacaataacaagctcggaataagtagtgcttgaaataattttagcagctaatccaacttgaactataatgagagccatctcgccacgactgaccattccaccaccaattgttaaagattctaattttgaaaaattaaagcctcgaccgacaaagtaccctggaattaattttgataaaacagccaaagcagtaaagattaatatcgtgtgaaggtgagacatcattccatcgaatttaagaggtagtgcaattgaagcgaagaaaattgggataaagaaggtgtaactaagaagtgaaattttatgttctaccttatcaacaaaagaagtttgtccaatagctaatcctgcaaaaaacgaaccaatgatagaactcattccaactttatcggctaaaattgatagagaaaaacagataaggatagcaagaatagtatatttctcaaagaaatgaaccttttcgattaatttgaaaagagcaggtacaaggtatttcatacaaataaataagaaaacaaagaataacaattgaatgataatttgtaatccgatattagaagagcttccatttgttgcaataaagacactcagaagcaaaacagctaagacatcatcagcaacagcagcacctaaaataatagcaccagtatctgtttttacacgattgtattcttgtaaaacttcaactgtgatagaaatactagttgcagcaaatacgagcccgtaaaagatagcagtattgatttggaacccaaacaagcgtgtcaagaagtagaagagagccataggaacaataacaccagtaattgcgaccagtagactgggcttaagatacttctttaaaagatcaaaattagcttcaagacccgctaaaaacatgagtaagataacaccaatttctgacaagacatgtaatacctgattttgatgaacaagtcctagcattgcaggtccgatgatgatacctacaagtagttgtccaacaacagccggtattccaattctttttgaaataagagttgcaagaacgcttgccaacaaaatgattgtaatttgaatgataatatgcattttttcctcctaatattaataaaatgatatcaatcatattgtactgaatatttagaataccattttttaagcctaaaatctaggaatatttcttttctgtctttttcatattattatcaagaaaatggaaaaatatactgaaaaatattcaatttaagaataatgaacttgtaactatcgaactacataaaaatgatattttaagtgtaagtatctcttattagacttcctgcgaaacaaaatatggtacaatagttctatgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaactagcgaattattctggtaaaaagaaatgtcatgctatgaaggctcaggcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattttagtttcgcaggaagtctattcaagaaataagagtaaaaaaacttagctacttaaagtagctaagtttttattcccactcaacagttgcaggtggtttacttgtaatatcataaacaatacggttaacgtgatcaacttcgttaacaatacgtgtcgaaattttcttaagtacatcccaaggaagttgcgcaaagtcagctgtcatgccatcaattgaagtaattgcacggatagcaattgtatagtcataagtacgaccatctcccataacaccgacagaacgtacgccagtattaactgtgaaatactgccatacgtcacgatctagaccagctttagcgatttcttcacgaagaatagcatctgattcgcggactgtttcaagtttttcttcggtaatttcacccataacgcgaatagcaagaccaggcccagggaatggttgacgccatacaacttcatcaggcattccaagtgcagtaccaagagcgcgaacctcatctttgaataatgtgttaagtggctcaatcaattcaaattgcatatcttctggcaatccaccaacattatggtgtgacttgattgtttgggctgtttctgtcccagattcaataatatctgtgtagagggtaccttgagcaaggaaatcaacgcctttaagtttacttgcctcatcatcaaaaacgtacacgaactcatttccgatgatttttcgttttctctcgggatcttcaacaccagaaagaagatctaggaagcgttttgaagcatcaacacggataatattaagtccaaatttaccaccaagcatatccataacttggtcaccttcatttttacgtaataaaccatgatctacaaaaatacatgttaattgatcaccgatagcacgttgtaggagtactccgacaacagatgaatcaacaccgccagatagtccaagaagtactttacgatcgcctacagtttcacgtatttttgcaatttccatatcaatgaagttatccattgaccaatcaccacgtgcgccacagatattaacagcaaaatttttaaggatatcattgccatatactgagtgacgaacttcggggtggaattggataccataaaattgtttttcagtattttccattgcagcaaatggacagtcaacagagtcaccaacgagatggaaaccctcaggaatttcagtgacagcatcaccatggctcatcaaaacaagttgttcttgaggagtgccagcaaagagtgctgattctgagcgtaggcgaagtgctgattgaccatactcacgatgaccagcttctcccgcaggaagaaccttaccaccgagtttatgggtaatcagttgcatgccataacaaattcctaagattggaattcctaattcaaaaatttcttcatcgattccaaaagcgccatcagcgtatacggaatttggaccacctgaaagtacgataccaataggattaatatcgcgaatttcatcagccgtaattttatgtgattttaactcagaaaatacaccaaattcacggatacgacgtgcgataagctggttatattgactaccgtaatctagaacgataattttttggatatcattcaatatagaaatatcagtcattgtttccctttctttgtagctaattttaaaaacagctgtacctataccattttagcatattttatataaattaacatcattaaaataattgattaaacgctttcttatcaagaaatattgcttatgatttttctgaattatttcacgattttagagttagaaatatatagaagtatggtaaaatgaagtgtagattctaggaggagagaatattgttaccagcatatattaaaattcacgacgctattaaaaaggaaatcgataaagggacttggaagattgggcagcggttacctagcgaaagagatttagcggatgattatagtgtaagtcgtatgacacttcgccaatcaattacattgttagttgaagaaggtattttggagagacgagttggtagtggcacctatgttgctagtcatcgtgttcaagaaaaaatgcggggaacaactagttttacagaaattgtcaattctcaagggcgtaagccatccagtaaactaatctcatttcaaagaaaactagcaaatgaaaccgaaattcaaaaattaaatttatcacagtcagattatgtggttcgtatggaaagggtacgttatgctgataaggtaccgttggtttatgaggtagcctctataccagagaatttaattaaaggttttgaacaatcagaggttacagaacatttctttaaaaccttaacagagaatggctacgaaattgggaaaagccaacaaactatatatgctagaaatgctagtgaacgtgttgcttcgcatttagaagttaacgcaggccatgctattttggcattgacacaagtttcatactttactgatggtaagccttttgaatatgttcatgggcaatatgttggagatcgttttgagttttatttagagaataactagtagtttaatgaataacgttttttgaagaagtagctatgtatgttataatggaaaaataaattatatagaaagatttgaggaagtagttgactactttcaagaggtattagttcatgtctcaatcttacattaatgttatcggcgctggtttggctggttctgaagcagcttatcaaattgctaaacgtggaataccagttaagctttatgaaatgcgtggggttaaatcaacccctcaacataaaacagataattttgcagaattagtatgttccaattcattccgcggtgattctctaacaaatgcagttggtcttttaaaagaagaaatgcgtcgtttggattctatcattatgagaaatggggaggcacatcgagttccagcaggtggagccatggccgttgatagagaaggttattctgaagctgttactgaggaaatccataaacatccattaatcgaagtaattcgtgatgaaatcacagatatccctggagatgctattacagttatcgctacaggaccattaacaagtgatagtctggcagctaaaatccatgaacttaatggtggtgatggtttttatttttacgatgccgccgctccaattgtcgataaaaatacgattgacataaataaagtttaccttaagtctaggtatgacaaaggtgaagcagcttatctaaattgtccaatgaccaaagaagaatttatggcttttcatgaagctttaactacagctgaggaagcaccactaaattcttttgagaaagaaaaatacttcgaaggttgtatgcctatcgaagtgatggctaagcgtggtattaaaacgatgctttatggtccaatgaaaccagttggtttggagtatcctgaggactacaaaggaccgcgagatggtgaatttaaaacaccatatgctgttgttcaattacgtcaagataatgctgcaggctctctttataacatagttggtttccaaactcatcttaagtggggagaacaaaaacgtgtatttcaaatgattcctggtcttgaaaatgctgaatttgtccggtatggtgttatgcatcgcaattcttatatggattcaccaaatcttttaaaccaaacctttgctacacgtaagaacccaaatcttttctttgctggacaaatgaccggtgttgaaggttatgtagaatcggcagcaagtggtcttgtagcgggaatcaatgctgtccgtcgcttcaatggggagagtgaagtagttttcccacaaactactgctattggtgcactgccacattatattacacatacagacagcaaacatttccaaccaatgaatgttaactttggtatcatcaaagaattagaaggtccacgaattcgtgataagaaagagcgttatgaagctattgctacacgagctttgaaagatttagaaaaatttctcaactattgatatattcatttgactttgccaacaagcaaggtcaaattttctatattgatttttaaaaatgtatgaatggagtaaatatgcactataaagaattacttgagtcatccgaaaaagcttatttggaaactaatcggtataaacattttaagaatataatcatttcagagcgttatttttcaaactatattagctacaaaataatgcctacagtaagtgagtttttacaggatatgatctatttagcagatgaacaaaaagattatcagtctgattttgcttttgtattttttgaggaaaatgctgaattgagcagtgaattacagagaactttatcacaacaaggctttgaatcagagaaacatatcatatttacaaattcattaaatcatcttaaactttttgaaaaagaatttgatgacatcacatttactaaacttaatgaaaattacctagaaaaatacctaaagttcaaatataaacaaagtatagtttacggagaaatttacgctaagcaaatgtataatgataatcgtgttaatcttttaaataataatgctaaagtttacctagctattaaagataatcaaattattggagatgtaacagcttgggactatggtgaatacgtggaaatagatgatttttatgtccaagagtcctacagaggacaaggaattggtacgcgcctacaatttgatgcaagtagggggtttaagaaagttatcttaatttcagaagaagaaaacagaaaaatgtatgagcaccaaggttatgaggaagtcgcctattattggaccgctttacggagccctcgaaagtaaaattataaaagaaatgatatagttaaaagctatatctcttgattgataataagtattttttaatccattagctttttgttacactagtatcagttgattaatcatacaaccatatcaaaggagaaataaattatgaaaatcaaaaagctattagggttaacgacaacagtagtaatttcagcacttattttaggagcctgtggtcagtctaaaaatgaagacgccaaagtcgttagagttggaacaatggtaaagagtaaaactgaaaaagctcgttgggataaaatcgaagaattagttaagaaaaaaggcgttaagctaaaatttacggaattcacagattatacacaacctaataaagctttagaaagtgatgagattgatattaatgctttccagcattataattacttaaacaattggaataaagcaaataagaccaatcttgtttccgttgctgagacatactttacttcctttagattatactctggtactaagaacggtaaaggtaaataccaaacagtttctgaaattccaaataaagcaactattactatcccaaacgatgcagttaacgaaagtcgctctctctacttgttacaatcagcaggcttgctaaaattgaaagtatcaggtgatgcattagcaacaatgtcagatgttgtttccaatcctaaatctttagatttaaaagaagtagatgcagcacagaccgcacgttctttggattccacagatgcagcagttattaataatgattttgtgacagaagcaggaataaatcctaaatcagctatttttattgaaccaaaaagtaaaaatgcaaaacaatggtacaaccttttagttgctcaaaaaggttggcaagacaaatcaaaagctaaagccattaaagaagttgtgaaagcttaccatacagatgcggttaaaaaagttatcgaaaaaacatctcaaggtttagatcaacctgtttggtaaaaataaataagcatggtcaattcgatcatgcttatttatttcgattttttttgagtaattgactaggggtactcaatacttctgttaaccgttgttgtcgtgctttacttttttcggatttagataaaagtagtgtcttactttcttcaaggatatcctctgtaatatagtacaacttcactaatgaaccgattctgaccctaccagctttaggcgacatattcacaacttgattaggatgtagggttgcccactttgaatttggttcagcaacaatccttgatacattaaaatggcgttgctctaagtaaacttgcgcatcattgatatcaaggtgtactacattatcaagctgagtataagtctgtttttttttcatgacgacggtcaagttctttttcaataattggacgagaattatcaattgcttttccaataagttcagttgtgtcagggattattgaaattaatttaccaataggccctaaagattttgtcaattttttacttgtcttggccatatgttttcaccgtactttccatttgttatgtaagatattatatcaaaattatagtttataaagcttttaaaactttcaaatttgtaagaaataggtcttaagatgtaaggttatagtaaaccattttgccatataatagacttaaagagaaagggggagcaagagatgcggcgaaaaatagttttactttttgtagttccaatgcttatagttttaggaattttaggagtggtagttcattattatggttcagcattaaatatttatctattacctcctagtagcgaacgttatggacgtgttattttagatcgtgttgaacagcgtggtttgtattcgcaaggtcgtcaatggcaaattataagacaacgatcagaaaaaaagttgaaaacgtcaaaatcttaccaagagagtcgcaacattgtacaggaagcagtacggtatggaggcggtaaacatagtcaaatattatccaaagagactgtacgaagagataccctagatagtcgatatccagaatatcgaagattaaacgaagacattctcttaattactattccttctataagtaagttagataaacgatctattagccattatagtggtaaattacaaaatatattgatggaaaaaagttataagggactcattttagacttatcgaataatactggcggcaatatgatccctatgattgggggggtagcctctattttaccaaatgataccctatttcattatactgataagtatggaaataagaaaacaatcacgatgaaaaatataccgctagaagcattaaaaatatctaggaaaacaatcaatactaagcatgttccaatcgctattataactaatcataaaactgctagttcggcagaaatgacttttttatcatttaaaggattacctaatgttaaaagctttggtcaagctacagcaggatatacgactgttaatgaaactttcatgctttacgacggtgctagattagctttaactacaggaatagttagtgatcgacaaggatataaatacgagaacacccctatcttaccagatcaagtaaccagccttcctttacaagagtcacagtcttggttaaagagtagaatcaatcaaaattagggtataataaataaaggagaattatatgttattagaaatcaatcacttagaaaaagtttttcgtacacgtttttcaaaagaagagacaagggctctacaagacgtcgattttaaagttgaacaaggggaattcattgctattatgggagagtctggttcgggaaaaacaactctgctaaatattttagctactttagaaaaaccgacaaatggacaagtgattttaaatggggaagatattacgaaaattaaagaggcaaaattagcgagttttcgtttgaaaaatcttggtttcgtctttcaggacttcaaccttttggatactctctctgtaagagataatatctatcttcctttagttcttgatcgtaaacgttacaaagaaatggatcatcgtttgtcagaattatcttctcatctgagaattgatgacttattagataagagacctttcgagctctctggtgggcaaaagcaacgtgtagcgattgctcgtagtttgataaccaaccctcaaattttattagcagatgaaccaacagcagcgttagattaccgtaattcagaagacttgctgaatttatttgaaactattaacttggatggacaaactattttgatggtaacccattcagcaaatgctgctagtcatgccaaacgcgttttatttatcaaagatggacgtatttttcaccaactttatcgtggtaataagaataatagcgaattcaataaagatatttctttaacaatgtctgccatattagggggtgaataatatgttttatctcaaaatagcctggcataatttaaaacattctatagaccagtacataccattcctcttagccagtttattactttattcattgacttgttctacgctactaatcttaatgagtgctgttggaagagatatggggacagcggcaacggttctttttcttggagtgattgttttgtcaatctttgcggtagtcatggaacattatagctacaatatcttgatgaaacagcgtagtagtgaatttggactgtataacattttggggatgaataaacgtcaagttgcgcgtgtagctagtctagagctgtttattatttatatatttcttatttctataggaagtctgtttagtgctttttttgctaaatttatttatttaatttttgtcaacattattaactatcatgcactaaatcttagtttaagtttatggccatttattatttgtatcgttatatttacaggtatttttctgactttagaagttccagttattcgacatgttcatttatcatccccattaagtctttttagaaagaaacaacagggagaaaaagaaccaaaaggtaatcttatacttgcaattttagcgttagtagctatcgccatcgcttatacaatggctcttacttcaggtaaagcacctgcattagctgttatctatcgtttcttctttgcagtacttttagttattgctggtacttatcttttttatattagttttatgacatggtacttaaaaaggttgcgtcaaaacaagcattattattataaatctgagcattttgtatcaacttcgcaaatgatttttcgaatgaagcaaaatgcagtagggttagcaagtatcactttattagctgttatggctctagttactattgctacaacagtctcactttattcaaatacacaaaatgttgttaccggactatttccaaaatcagtaagtttatcaatagataattcaaaaggtgacgcgaaaaatatatttgaagaaaagattttgaagaaactaggtaagtcatctaaggaagctatcacttataatcagacaatgatttcgatgccagttagtcaatcaagtgaacttaatatcacatctaaaaacgtcaaacatgttgatatcacaaaaacgggttttatgtacctaattactcagaatgatttccgtcgtttaggtcaccaattaccaaaattaaaagataaccaagtggcttactttgttcaaaaaggtgatagccgtttgaaaaaaataaatctattgggaaataaatttgacgttgtaaaaaatttaaaagaggcttatgtcccagagactacaaatacttacaacccgggtttgattatatttgcaaacaacaaacaaattgacaatattagaaaagcatatttaccttatactaagaacatcaatacttttccaaaaacctttaaggcatatttggatttgaatagtcaagagataaattcaatttctaaaaacgacataatagaggtagatggtaagtatgttggaaatattagcactaaacagagttttctaaaagaaggttatcaaatgtttggtgggttattatttactggatttctgttaggtataagctttttgctaggtatagctctaattgtttactataagcaatactcagaaggtcatgaagataagagatcttatcgtatcttacaagaagtaggtatgagcaaaaaattagttaaacggactattaattctcaaattatgattttcttcttccaacctttagtggtagcagttattcactttggagttgctattccaatgctaaaacagatgcttttggtatttggggtgcttaactcaacaatcgtatatgtagtaagtggtttgacagtacttgcgatttctataatttactttatcatttaccgtataactagtcgaacttattatcatattattgaacgctaaaaaggattggttattttaccaatccttttgcattaatagaaaccgatagactaaaaaatttgttatactaaatgaaagaaagagatttcgtactattttaggaggggatatgtcacaagagcaaggaaaaatttatattgtagaagatgatatgacgattgtgtcacttttaaaagatcatttatcagctagctatcatgtctctagtgtcagcaattttcgtgatgtgaaacaagaaattatcgcatttcaacccgatttgatactaatggatattacgttaccctattttaatggtttttactggactgcagaattgcgtaagtttttaacaattcctattattttcatttcatctagtaatgatgaaatggatatggttatggcattaaatatggggggtgatgactttatttcaaaaccattctctctagctgtattagatgctaagctaactgctattttaaggagaagtcaacaatttatccaacaggaattaacttttgggggatttacgttgacaagagaagggttattgtctagccaagataaagaggttattttatcgccaacagaaaataaaatcctatctatcttgctcatgcatcctaaacaagtagtctcaaaagagtctctattagagaaactttgggaaaatgatagttttattgatcaaaatacacttaatgttaatatgacacgcttacgtaaaaaaattgtcccaataggttttgattacattcatacagtgagaggagttgggtatttactacaatgatacgccagtttttaagagaacacttgatttggtatattttatatatcatgatgtttgtcctattttttattagtttctatctatatcatttaccaatgccctatttgtttaattccttaggtttaaatgttattgttttactaggaattagtatttggcaatacagtcgttacaggaaaaaaatgttacatctcaaatattttaatagtagtcaggacccctctttcgaacttcaaccgagtgattacgcttattttaatattattacacaattagaagctagagaagcgcaaaaagtttctgaaacaattgaacaaaccaatcatgttgcacttatgataaagatgtggtcgcaccaaatgaaagttccattggcagctatttcattaatggcccagacaaatcatctcgatcctaaggaagttgaacaacaattattgaaattgcaacattatcttgaaacgttgttagcatttttgaaatttagacaatatcgtgacgattttcgttttgaagctgttagccttagagaagtagtagtagaaattataaaatcgtataaggttatttgtctatccaaaagcttatctatcataattgaaggcgataatatctggaaaacagacaaaaagtggttaacttttgctctttcacaggtgctagataatgccataaaatattctaatcctgagtcaaagataataataagcataggagaagagagtattagaatacaagactacggtatcggcatactcgaagaagatatccctagactttttgaagatggctttacgggttacaacggtcatgagcaccaaaaggcaacaggcatggggttatatatgacaaaagaagtcttatctagtctgaatttgtccatttcggtggatagcaaaattaattatgggactgctgtttctatacataaataaagttatgtaaaataaaatatttacataactttatttatgttactatagtttatctaaagcgttcttttgttcatcgttaacaatatgggtatataggtcagtaacttgagtggaagcatgacctagttggtggctaactaatacttgagattttgtagcatcatatagcctagtagcaagagtatgccttagtttatgaggtgttacacgaaccttaaaatcctgggaatacttagcaaccattttctctacacttgaagcatcaatacgatttggcaccccacggtattctgataaaaatagagcaatgtcctgattttctgctttgtatctatttttacggatgtctaaataattagcaaggtagggcttcgcaaagctagcgacattgacagagtcccttttccccccttttcgtgtgacatcaataaccattacattaaggttaatatcctttaaatctaagtttactgcctcagatagacgcactcctgaagctagtagcaaagcaataatagctaaatctctctctttatttttgttgaaaaaagctaaagcacgtttggaaagtttgttttgatattcacaatctatatactctaagaattctatcgtttcattgcccaaaaataacttttgtttaatattttctgcccgagaagctaaagtttcctttttctttttggttgagacttttttcatgacattgcgataaaagtaaggctccccgtcagcattctcaacctcttcagtaaggtatttgaaaagactagataaggcagatagagttctgttaatggtggtttgagacaccccattttgccttgtgttagcatttaataaagggcgttctcgtaaatatagtataaaagcttccatatcttttttagtaaggttttctaaaactgaaagctcaatttctgcaatgtgatgacaattagcaacaccagaatccaataaccattcaagaaaacgtctatattcttttaaatattcgtagagtgttgtgaaactataaggaacagaaagctttgattgataatattctagaacataccaaggcataatttcttttagttcatcgattttttcgagtagtaattcacgtttcataataaaatctccattatatctataaatagaagtatatcatactctatcataactttcaagaaaattatagtttttcggaaagtttaaaagttaaaaacaggaattcattcggtaagtatatcaaatatccattctttatgatgatcagtattacttattatcgtttaacatgtttgttatagtaaagacagagtattttgagaaaactgattcataatttcattgattttatcggtatctgaaaaggtaataaagtgtactcaattatttttaattatatttgcaagttaataaccaaagttaaattctactttaaaatatactagttttctcaatattagatctactatgtcttataaaaatcagaagatttgaaatatttctttctttcttgaaattttatgatataatatgtcctatatctttatagaaggtttaggaggactggtattatgtctagttttaatagaaaaaaacttaagtttttgggtatatctttggcgactctaacagccaccacagttaccctggttgcctgtggtaatgagtcaaagaactctggagataataaagttattaattggtatattcctactgaaatcagtacattggacatttcaaagaatacagatgcttattcaaacttagctataggtaattcaggcagcaatttacttagaattgataaagagggcaaaccaaaacccgatttagctaaaaaagtatccgtttcttctgatggtcttacttatactgctacacttcgtgataatttaaaatggtcagatggaagcaaactaagcgctgaagattttgtttacacatggcggagaatagttgatcctaaaactgcatctgaatatgcttacttggcgacagaatcgcaccttttaaatgctgataagattaattctggagatattaaagatttaaataaacttggtgtaacagctaaaggcaatcaagtgacctttaaattgacaagtccatgccctcaatttaaatattatttagccttctctaattttatgcctcaaaaacaatcgtatgttgaaaaagttggtaaagattatggtacaacatcaaaaaatcaaatttactcaggtccttaccttgttaaggattggaatggttcaaatggtaaatttaaattagtcaaaaataaatattattgggattctaaacatgttaaaacaaatagtgtcatagttcaaactatcaaaaaaccagatactgcagttcaaatgtacaagcaaggtcagattgattttgctgaaatatcaggaacttctgctatttatcaagctaataaaaataataaagatgtagtagatgcgtctgatgcacgtactacatatattatttataaccaaactggttcggttaaagcattgacaaatcagaaaattaggcaagctttgaatttagcgactgatcgtaaaggtgttgttaaagcggcagttgatacaggttcaactcctgctgaatctctggtccctaaaaaattagccaaattacctaatggtgaggatctttccaagtatactgccccaggttatacgtataatacaagtaaagctcaaaaactttttaaagaaggtcttgctgaggttggtcagtcatctctcaagttaacaatcacagctgattcggactctccagcagctaaaaatgctgttgactatgtgaaatctacatgggagagtgctttgcctggtctaactgttgaagaaaaatttgttactttcaagcaacgccttgaagatgcaaaaaatgaaaattttgatgtcgtgctcttctcatggggaggagattatccagaaggatcaactttctatgggttattcacgactaattctgcgtataattatggtaaattttcttctaaagagtatgacaatgcctatcaaaaggcaattactactgacgccttgaaaccaggagatgccgctaatgattacaaaactgctgaaaaagctttatttgatcaatcatattataacccagtttattacctagggaaaaaaggactccaaaattctaaattaaaggggttggtaagaaattcaactggtttgaatgttgattttacttatgcttataagacagaataaaagaaaagcgttaggatatttctagcgcttttctataccaaaagtaaccaatgagttatcaaaacacttataattgagaacaatgatccaattaaataatattcggcaaaaacctgacttttagaaattttatcgtaacgtgcaatggattttgcagtaaaaacaagacctatagcagcatactgtcctgagattagtaatatagccataattagacgctctaaattaccaatcatagctcctgctccttcaattgtttcttcatgatcttcagatttttctttcattatttttgttttttcttgtgttaataatgatgataattctttagcttgaaatttattaaagaaaattttaaacacaatattaatgggtttggtgataatgataaaaaccagagctatgacaataaagtgcttgataggcaaaagccaatgattaggcggtaaatatgtaggaagcgcatggtaaaaaacgataatgcaagtatagtgggctagttggtctataataaaagctgctttttggaaatgcccttcctctacccaagggtaactcaatttctttatactatcaataacaatatgacttccccatatgcttaaatttaacaaagtagtttctggtatcaatatcattaaagctgctagggggaggaaaacaatcaagagatgtctccagagtcccctccaactatgtgatttactatctgctaaggattgactttgccactgaaagtcagctaaaaaatgtgcacaaaataataaagttaggattggattatcccttaaaaaatcagaaatcatagcttccccctttagtttgagtgcaacttttaactaatagatcggctgcctgtgttctcgttcttaagtaaatcttcagaccgcttgctttaaggcgtttagtcagcgcactaggttcaatattttccagttgggctaacttttgatgttgaaattgttcttgataattatcttgaagtattaagtgctcaagcatttgaaaatggtttgtagtccattttgacttgataaaatcaccagctgaaatgagactatttagtgttaattcaaggttttggtcttcatcatcaaggcaaatagctacttgaactgttccataatcatttttatcatgtatatgattaatagctgagcgagcatgccagtaggcaggaccatcagcaccgatactttcatttgaattgatggatgttataatgtttcctgtaccgaggccgaaccttacattaacaggttttagagctagttgaatatggtcaataatttgaaataccttttttgatggtttcaataaagcttgaaattcatcaccagctgtaatagtgaatggagaaatcagctcttcaccatatacatcagatagttcggtcattagttgctgaaaagactgttggaaagtttcacgttcaagtatctgttttgaattaatgatatcaccgattaatgctaaatacataaatatcaccacctttttgtctattatagcagacaaaaataaaaatgtctatttaaatagacatttttatttgcgtttcttcttagctttcttcattttattagccatacgtttcattgattgtttagctgcaaaggctcctacttttccttttaagccaccaccaaacatttggctgaagtccatatcgccacctaaactagataagtcaggcatgccattttgccccatcataccttctaaattagacatatccattccgtccattccaggcatatctttagggaggttattaggatcaattcccatttttttcatcattttattcatatcaccggacatcacgccttgcatcatttgttttgcctggttaaaatctttaatgaatttattaacatcaacgaaagtattacctgatccagcagcaatacgacgtctacgacttggattgaggagatctggattttctctctcttctggagtcattgatgacacaatggctcttttgcgagcaatttcgttttcatccactttgaagtttttcattgctggattgttagccattcctggaagcattttaaggagatcttccattggccccatattttgaacttgatctaattgatcaataaaatcgttgaagtcaaaggtgttttcacgcattttctccgctaattccattgaacgtttttcgtcgtattcttgactagcgcgctcaataagtgttagcaggtctcccatccccaatatacggcttgccatacgatcgggatggaaagtttcaatatcagtgattttttcccctgtccctgtaaatttaattggttttccagtaatttcgcgtactgaaagggcagcaccaccgcgtgtatcaccgtcaatctttgtcagaacaacaccactaatgctgagctgacggttaaattcttcagcgacatttgcagcttcctgtccaatcatgctgtcaacgacaaggagtatttcattaggttgagctatggctttgacatcatgcaattcctgcataagggttgcatcaatttgtaggcgtccggctgtatcaataagaacatagtcattacgattttcacgagcctgttctaaacctttagtgacaatctcaactgctgaatggttagttcccatatcaaagacaggaacattaatctggctaccaagggtttttaactgatcaatagcagctggtcgataaatatcagctgctatcatcataggacgagcattgtcttctttgattagtttgtttgctaacttaccggcaaaagttgttttaccagcaccttgtagaccaaccatcataatgatggttggaattttaggggatttttcaatttcagaggtctcagcccctaataaatctgttagctcttcattgacaatcttaacaatttgttgcgtaggatctagtgtatcaatgatttcatgtccaacagcacgttcacgaacatgtttaataaaggttttaacaactggaagagcaacgtcagcttctaaaagagctagacgaatctccttggtgacttcttgcacatctttttcagataactttttcttaccacgaatatttttaaaaactccttgcaggcgctctgttaaactttcgaaagccataaattatttctcctcatttaatctctattatcaatgctacttagaatggaaattttttcttgtaaaaaggcatcatcggtatatttttctagaatgtcatcaaaaatctgactacggacaatataatctgaatacatatgtagtttcatttcgtacgcctcaagaattttttcagttcgtttgatattatcatagacagcttgtcggctaacaccggattcttcagctatttcagcaaggctgtagtcatcggcgtagtataactcgatataattcatttgtttatctgttaataatgccgcataaaactcaaaaagggcattcatacgatttgttttttcaatttccatagcttttattataccaaatttcctatcagcttgctatatcaagtatgcaagaccactttaaaatttaaaaggttaggactaacatggcctaaccttttacttttggtagttttatcttaaaaatactgcctctaggtttattatcaattactgtaatattacctcgcagtgagttaacgatttgttgagctaaagaaaggccgaggccaaaccctccttgttgtcgtgttcttgctttgtcaacacggtaaaaacgatcaaaaattctgactttatcctcctctgaaattcctggtccattatcagcgatttctaaaaagagatacttatcagtttcagatatggtaaagtcaatgctaccatcattgtcagtatattttatagcattatcaaataaaatagtcatgagttgttttagcagtgtcttatctgttttgaaactatcttggatcatattatgtccagtaaaatttttaccattctcttgggtgattagatcataattctcaaagatactatcaaaaagtgtaggcttaataacagctaattctggtttgattccatcatcacgtcttgctaagtttaaaagattagtggttaaaatacgcatatttcgtacttcatctagacttgaagcgatattttcactattttctaaaatggtggcattcggttttctgaatagcgtttctaggcgattttgtaagacagctaggggagtacgcagctcgtggctagcattttcgacaaaagccttctgtctttcgtagttttctataatcggtttttgtgcccatttagctaagtagatacttgctccaattgaaataatccaaaaagtagtcatgacaaatataataattttttcatagcgttctttagcatttactaattgatcaatattaacaatagctgtcatgtaagtcacattaggataagcagggttattaacttttacggtgacagcatgatatgtctcatcttgaccaaagatgttggttaaagttaattcactaatgccacctagattttttttattaggttttaaaaactgatagtttgaaaatgcgtcaaaatagttaatgacttcttcttctgatgtaaaaagaataatatcagtattagctactgtctgaccgccgggttttaacttgacacttgcgatattggagttatctaggtaggcagcagtacgtgacataaccatattgatgtaatttttaggatgggtactgatatactttaaactactatcaacagaagaataaacaccatagcgcatgacttggaggatgataacagtcataaccagaaaaataccactaaaaactgtgaaaaaatggataaaatgactatctgagacattttttttgaatttacttatcttaatcggtttcgacatgctttaaaatatatcctacactacgcaaagtttgaaggttttctgaaaaaagtgttccttttaattttttccgaaccttagagacatagacttctacaactgaaatcgttgtatcactatcaaatccccaaatacgatcaaagatttgagatttcggtaagataacattttgattttgaaggaaatagactaaaagatcaaactctttacctaagagctcaacttctgtttgattaacaaaggttgagttagtagacatgtctacgcgaatatcaccataaattaggctgttatcattaaattttccagaacgctttaaaagagcctgaattcgcatttttagttcttctaggtaaaaaggttttgttagataatcatcagcacctaagtcgaaaccttgtcccttatcatcaatgctttctttagcggtcattattaatacaggggttgtaatacctttttcacgtagctctttcaacacttggaagccgtttttttcaggtaacatgagatctagaagaatcagatcatagactccactttcggcttcgtaaagaccctcttctccatcaaaaatttgcatgacatcggcaaagtcatcaaggaaatcaaaaacggaattggaaagactcaagtcatcttcaattaataaaatttttatcatagtatatcctttcgatgtacatattttatctgaactattaatattagaataccaaactttgcttaataaatcctaaataaagtatgttttatgtcaactaatttcatgacacagacaaagaaatagagattgaataatccatcaatctctatttgagtttattagatatattttttgatagtattgataacttcttctttttgcttcgtgattaaaaggacacgagcagaaatttctttaattcccattgaaatattacggctaatcgccatatcgcttaattgaggctcgaaaaagtttttatattgttcaaggcgttcttctgttttgaaactacttgagggataaatcacaaatttatcaaaactcatatcaccacctagagttgctttgatccattcccagttttcttgggcccactcccagacactttcttgtgtaaaagaatttttaaggaaagtagcataccaactcatagctaagtcttgtggtttcacaatatctttatttttccaatctgacaataatttcttgagtgtcttgctatctgtagtatgagataaagcactcgctagttgtcgtttgaaattcccatcggtagtagtactataagtctctaataacaagtggctaagttctttggattcgaaatgcttcatttcattggtaagaactaacaggcgaattgcagctggtatagcagcgatattattttcgtgggctttaaaaatatggtgagcttcttcaatagcatgttcattatctgagtagagagcaaggcttagggatagatgacggaccatttcgctatcatctccttctccttctcttttttcaaagccaagtctattaaaattaaatgctgataatttattaacaaattctttaaagtcgaattcatcttggctatcttcctggacgaataaggataaaccatcaataacactcttaatagcagagttaacaagatatgatgtctcttggctcaaaagagagactaaaggtattaaactactatatgaaatcataccactttcagcaagtaaatgacgttcttgtacaatttgtagtttagaaatgttatccataagaggaagatcagaaatgatatgctctaagagttgaccttgatagttagtaatgtaatgtgcagtattttcagtattgaaacgcagtgcaccattttctttgttcttttcagctaactgactaaaattggggattactaccgtttcctcggttaatatctctgggattccttcccaattactattaagaggaatttgccacaagcgagacttatcttcgtgttcaccaataaagaattgtttttgagttaaaatgagctcatcttcttctattttggctgccatcacagggtatcctggttgctctaaccaagaatccatgaaagctgcaacatcttttcctgaggtttgagaaagtgcattccaaaggtcacgaccaatagtattttgatattgatgtttttcaaaataaatttttagtcctgcggcaaaatctgtatcgcctaaccagcgacgtaacatgtgcatgaggcggctaccttttgcataaacgatagctggatcaaaaagtgtgttaatttcatcaggatgattgacctcaacgtgaacagattggacgccatctgtggcatcacgcttaagagctaatggtagaccacctgtttgaaagtcttcaaatatattaagttttggttcaatataatcaattgatacatattccatcatattagcaaatgattcatttaaccataaatcatcccaccatttcatagtaacgaggttaccaaaccactggtgagctatttcatgtgctacaactaatgctacttgctgacggctggaaacactagagttctcatctactaaaagatagacttcacgatatgttactaatccccaattttccatagctccagcagaaaaatcaggtagagcaacgtggagtgactgaggaataggataacgtacaccaaagtagtcctcataaaactcaataacacgcacaacgatatctaaagaaaaatctaattcatttaactgatgggcttttgtggcatatgagccaacaagagtgccgtttttggtatgtgttgttttaccatgcaattcccccaaggcaaaagctaataaatatgaggacattttaggtgtggtgtcaaatgtccataaacctgtttcttgacgttgttcagcattgatttccggcatatttgaaagagcaatctctccttctttttgatcgaattttaggctcaaatcaaaggttgcttttgcttctggttcgtcaatacttgggaatacttcacgagcaaaatgactttcaaattgtgtggagataacctcttttttgatgccattaactgtatagtaagatggatacatacctgtcatattatcggtaatgtgaccgctgaattcaaagactaataccatgctaccagtttcatgcaattgaatatgcatagcttcattgtcttcatctagttggaaatctaatggttgattatctaataagacagatttaatggttaaccctttttggtgaaaagagatattgttatctaaggcttcgccagacacagcaacgttacctgaaaaggttttagtttgacgattaatatccaagaaaaggttatagttttcagggacaaatttggtaacaaaatgttctacagttttcatataactcctaactaattcagaaacatttgaaacattactagtcctgtatgggctagaaaagatagaaaagctgtaacaagatagttacagcttttctatcgcacgaactatacttacaattaccactctacaagcaataattatatcataactcgataatttttccagtttttaaataaacaatccattcacagatatttttgccataatctccaattcgctccaagtgcatcaatacttggaagtattctttggcggcaaatgctacgtcaggatgcttttgaattgtttcaactaccattttttggatatcacggaagtaatcatcaactatttcatccattgctgctacttcgtaagctttttcatcatcaccattgatataagctgttaaggcttcttcaagcatgtttttaactgcttttcccatattattgatttctaattctactgctgggattctttcctcgcccttcatacggatggttgcttttgcaactgctgctgcatggtctcccatacgctcaacatcactagtagcttttaaaacggtaataacggtgcgtaagtcttgtgatacaggctgctggagtgcaataatttccaatgattttttctctaacttcgtttcaaagttgttaagcgttacatcatcttctatcacttctttagctaactctcgatcatgactgacaaaagcacgaactgtttttttgatttgtccgatagcttcaattcccattgcatagaattggttatgcagtttatctaattcttcatcaaattttgatcttaacatattgtattctctttctgatcttattatatggtattaaccgaatttacctgtaatgtaatcttcagtttctttatgtttaggattcataaacatttcttttgtattgccatattcaattaagttaccgtctaagaagaaacctgtacgatcagaaatacgtgaggcttgctgcatagaacgtgtaacaagtaacatggtatattgatcttttagaccatgtaaagtctcttcaattttaccagcagaaattgggtcaagtgcagaggttggctcatctagaaggataattttaggcttggtagcaagggttctggcaatacaaacacgttgttgttgaccaccagataaaccaagagcagagtcgtgtaatctatctttgacctcgtcccagatagacgcgcccttcaatgaagtctctacggcttcatctaacgtagctttgtcttttattcctttgagtctaagaccataaacaacattttcaaatactgacataggaaatggattaggctgctgaaaaaccatcccaatttctttacgaagttctacggtatcagtgcgcgggctataaacattatgtccgttatacatcactgctcctgttagagtgacttcaggatttaagtctcccatacggttaatagctcgtaagagtgttgactttccagaaccagacggaccaattaaggctgtaatttcattaggatagaagtccattgagacttcttttaaagcttttttcttattatagtaaacagacaaatcactgacttgtaaaataggttgtgtcatcttttacctcactatccaaatcgaccagaaacataatcgctagtagattgacatttagcattttggaaaatgttattcgttttatcgtattcgattaagtctccaagatagaaaaatgcagtataatcactagcacgtgctgcttgttgcatattatgtgttacgataattatagtgtaatttttcttgagttcaaacattgtctcttctagttgcatagttgcaatcggatcgagtgctgaagcaggttcatccattaagagaatttctggtttaactgcgatagcacgtgcaatacataatcgctgctgttgaccgccagataaagtgaatgctgatttatgaaggtcatcttttacttgatcccatagagcagcttgttttagtgaggtttcgacaacttcatctaagaattttttatcttttacaccagcacgctcatatgcaaaggtaatgtttttataaattgattttgcaaacgggtttggacgttggaaaaccattccgatatgttttcgcatctcgtaaacattgatatcttgagcgttaacatcaattccttcatacatgatttgtccagtcacgcgtgcaatatcaatcgtatcattcatacgatttaagctacgaagatatgttgattttccacatccagatgggccgattaaggctgtaattttatttttttcaaattgcatatcaattcccttgatagcttctttctcaccgtagtaaacgtgtaaatcttttgtggtgagagctgaattttcttcagggaaggtaatgatatggcgttcgtcccaattatattctgccattactactccttttaattagacgaggttaatttcgaatgaagtttcttaccgatcgagcgagctgaaaggttgaaaataagaataacaaccaataagactgcggcgctaccggcagatacttgtgttgcatcagggattgtcccttcgctattaactttccaaatatgaacagctaaagtttctgcttgacggaaaattgagattggacttgtaacactaaggacgttccaatttgaccaatcaagtgctggagcagattgaccagctgtataaataagtgctgctgcctcaccgaaaatacgtcctgaagctagcacaacaccagttacaatacttggcagagcttcagggacaacgacgtaaatgaccgtttcccaacgagaaatacctagggccaatcctgcttcacgctgtgtgtggtgtacattttgaaggctatcttcaacactacgtgtcatttggggtaagttaaaaacagtaagtgctaaggcacctgagataattgagaagccatattgaaattgaacaacgaagattaggtaaccaaacagaccaactacaacagaaggaagagatgacaaaatttcgatacatgttctaacaaagtttgttaaacgtccttttttagcatattctgagaggtatattccagctcctaaagatagaggaatagaaataatcagagtaacaataagtaggaaaaaggaattgtataattgtattccaataccgcctcctgcttcatatgatgatgatttcccagttaaaaatgaccaagatacgtgtggcaatccgcgaacaagaataaaaattaaaagagaggcgaggattgtaacgatgatagctgcaatactatagagtattgtagttgctaatttgtcagcctttttagcgttcatagtttttctttccttcccttgtaattaacttaataactgtattaaatgctaaactcataattaaaagtactaaggctagcgaccagaggacattgttttgtacagttcccattacagtattaccaatacccattgttagaacagacgttaatgttgctgctggtgttgtcaatgacgttggtaaaattgcagagtttccgacaaccatctgaattgctagagcttcaccaaatgcacgtgccataccaaaaacaattgcagtgaaaattcctggacgtgcagcgtttaatataacacgccaaattgtttgccaacgagttgcccccatggctaaacttgcttctttatagtgacgtggcacagctctaaggctatctactgtcatgaaagtaacagttggtagaatcatgacgaagaggacacagaccccagataaaatgccaaaacctgttcccccaaaaatagagcgaacgaagggaacaataatctgtaaaccaataaaaccgtaaacaacagaaggaatcccaactagtaattcaactgcaggttgtaaaattttagaaccatatttaggtgagatttcagtcataaatacggcagcaccgatagcaaatggtgtagcaatgatagctgatagaatagtaacaataaatgatccagctatcattggaaaagcaccaaatgacttagcacttggttcccattttgtattaaataagaagtctgttaatttaacgccatcaacaaaaaatgtagatagtcctttttgagcaacaaaaatcaaaatcatcgcaacaatgaagacgattagggcaagcgaaagaaaagttattcctttaccaaatttttctaatcgagagttttttgaaggagatgttaattttttagctaattcttgatttttcataattcctcctaggatcaagatgctttatctagatgtgattaagttttattttggggttactttaccttcagcatctttaacaactttcatgtcgttaatagagatatatcccatatgttgtacgatactactttgaactttatcacttttcatgtagtctaagaattcttttgttagacctgtttcattaccttttgtatacatatgttcatatgaccaaagtttccagttgtcggtagtaacatttttagctgttggcgcaaaaccatttagttttaatgttccgacagatttatcaacgtatgcaaaagcgaggtatgaaatcgcaccaggtgtttgagaaacaattgatttcaccataccatttgaatcttgttcttggctttgaataggagcaacatttcccataatagtattatcgaaggttgcacgggatccagaacttgctgctcgattgatgatggaaatatctaaatcttgtcctcccacttctttccaattcttgatttttcctgcaaaaatatcacgaagttggtgggtggttagatttttaacattaacttttttattaacaataacagctaatccagctactgcgacttgatggtctttcaatttcttagcatcaataccatctttttcttctgcaaataagtcgctattaccaatttgaacagctccagactgtacttgtgataagcctgttcctgagcctcctccttggacattgatagtcttaccgaggtttgtcttaccaaactcatctgctgcagcttctacaagtggctgtaaggcggttgaaccaacgctggtgattgattgacctttatcaatccaattagcacaaccagacagcgtcaataagacggtggctagcaaggttaacaaaaaaatgttttttttcattttcattttcctattcttttgaataaattttgatatttagtagttgatatatattactaaaatcattgagtgtttaatgatttacaaatagtaaaaacacacatcactgtcccatagtaccataagtttctagggtttgaaaagtatttctttttccttttttattaaaagtattcaataacagttatgtctgaaatcgtagtcctttagggtaataatttttaagagtattatttgtcacttttgcaaaacctaatccattgccttttacaagaatttgataccaaccgtttggaacagtcttgtctagtttgactacatttccagatacgtacacctcaaactgttctatatcaatttcaatagactgtactaggtcatgttcgctaagtgccattcctaaagcaaacgatggctcaaaacgattcttcttgaaagtgcctagatggagaccattgcgtgctatttttaatttagacaaatcggggagaccattaggtagaagatagagttggtcgccgaaaacatctaaaacaccgttcaagtctatctttaaatggtcttgtgcaaattgttgccacaattgtaactgcattttatttattttctgtgcttttggcttaattttctgtgcttccttagatctagtatctctcagttttgcaacgaattgtccttcaccttgaaaatgatgagggtacatccttgcaacttgtggtacattaatcccttcaaccatcccatttagtttaggaatatcaacaagttctaagtaatcatactcttgaaggagccaattaaccacttcttcgttctcttctggtgaccatgtacaagtagagtatacaagtataccaccatgagctagcattttgattgcttcttttaaaatatctctttgtaactgtgcacattcagtggggtaatctttgtgccaatattgtattgcttgaggatctttgcggaacattccctcaccagaacacggaccgtcaaaaacaataagatcaaaaaaagaattaaaacatttggctagtcgttgggagctttcattagtcacgataacatttctagcaccaaaacgttcgacattttcgactaaaattttactacgtttatttgaaatttcattactaactaatagaccagtattgtttaaatatgatagaaggtgtgttgtttttccaccaggtgcagctgctaaatctagcactttcattccttcttgtggttcagcaatctgagccactatctgagcagcaggttcttgagaataaacaaggccagttgtgtgttctattgattttcctgatattttcccataatgcccccaaggggtacttgggatggcatttggaaaatcaagttgcttttctttgagaggattggtgcgatatgccgatatgggtttttgttcaaaactgtcaaaaaaagcttctgcttcatctttaagtatagtctgatatttttcaataaattcattcggtaatttcatgtttctattatactacataatcacgggcgtgcaaaaaaaccttctatttaattagaaggttttaagtttattttttggtaaggtaggattggataagatttaatttcgactttggtaggaacattactttttgtcttgttgaatagttgggttcttccccgtcaagcgttaataaggtaaatcctaatgtctcccccatgatttttgctgcagcataatcccaaggttgaatatacgaaaaataagctaataatttgccctgcatgacttttgccatgctaattccagcaccaccatagatacgaacacctaaggtttcagaagctaaatgggcaataccgcaatcattttctgcatacatagcagaatttactccaagtaagcaacgttctaaaggacactcttgaaaaggaacaatttttttatcgttagcatagacatcaaaatgtcctcccccgctgtaaagaatatcagccataacgtcgtagatgataccaaattgtccaacgccttcttcgtaataagctaacataacagcaaagttatctttttgaacaataaaattaacagttccatcaatagggtctaaaacccaaacattaccttgtgcaatgggtgagcgcacatcatcttcttcggcaagtatattatcatctgggtaatgttgaataatttcttgaattaataatttttgtgtttttttatcaagacttgtcactaaatcatcaaatcgagacttttcctcaacatcaaaagtattttgcatctcagatttaatgaattgaccagctttatacactaattgtttagcgaaatcaaatttagcgtccaagtgaaataaatcctttcgcttgttgttgtgctgctttaacagcttgataagtggaataaccgctagttctctggaattcacggtcaatttgtttttcctgcgccttggatttaacaacttttttaaattctttatagctatctagcaaatcatcaactttaatactattttcataggcgtgttcaacttgatttaaaaagcgaagtaccttagtaatatcttccgtattccatgaaggatcaagaggataactataattactactaatcatgttttccctcaatttcagcacgaatagtggcctgtttcagttcttgtttacgatagtcacgcggtaagaaggcacgaatttcatcctcattaaaaccaatctgcatacgttttttgtctaaaataattgggcgtcgtaaaagacttggattttctgaaattaattccattaatgaagacgttgataattcgtctacatcaatagcaagtttttgaaagacttttgaacgtgtggaaataatgtcttctgtaccattttctgtaaacgatagaatttgtaatagttcttctttattgagtggacttgtaataatgttatgctcttcaaaagcaacctcatgcttacttagccaagcacgcgcttttcgacaactagtacagctgggtgataaaaataaggtaatcatataaccgcctcttgtatttactagagactattatacaaaaaattaaagagtttgactatcttttttccaatttaaagcaatttctttatcttttttaagttgttttacaagatcgtcaataccattaaactttaccatttctctgattctttttaaccagaaaatttcaatagtttctccataaatgtcgccatcaaaatcaaagatattagcttctaaacgaagttctgtaccaccaaaagtgatattttttccaatgctcgtcattgctctataatattttccattaatcagaacattggaaatataaacaccgtctgcaggtaagtaagtgcgattaataggagctagattagcagttgggaaccctatagttcgtcctctagcatctccatgtactaccatgccacaggttgaaaactcataacccaaaagttggttagctttctcaacattaccctctgtaatcaattgacgaatacgtgtagaagagattttttcaccaccttcagaaatttcatcaataatatagactggtcccttgaaattacgcgctagataatcaccactggtacgattatgaccgaacttataatcaaaaccgacaacagcagcttttgctctgagaccataaatatatttcttaataaaaaggtcagaagatacttttgaaaaatgactggtaaaattcattaaatataactcatcgacgccatactcttgaaatttttcagaacgtttttctggagaggtaagatgtagcaataattcaggttggaagcgagcgaaggttagacgaggtgtctcattaaacgttaagacgacaattttcaaatttttttcggtcgcgatttttttagctttatcaaagagggctttatgtcccagatgtaagccatcaaaatagcccaaaactaagacgcaatcttctttagcttgaatatctttataatcattaatgtaatggattttcatgattgactttctttataacaatactttgtgtggtttaaattcattgccacgtttttctagtatagcgataactctattttcataaaaagctgctaaggtatctgcttcattttctaataagatacgacgtccgtatgagatttcaactttatcttcctcagttaggttaacttttgggagatctaaaacaccatattcaattggaagtaaaaatgaaaaatcttcttgcttatatttttcattaatttcttcaagcgttaatgattgtgtaatagataatcctgcagatgaggttctttttaggaaagacatatggctagcatatcctagttttattcctagatcaacagctaacgtcctaacataggtacctttactgcatgagacatagaaactaaaacggcagatgcctttttcgaagtacaatgggcttgtgcgtctaaattcagaaattgttatttgtcgtttaggtcgctctacttcttctcctgaacgagcatattcatagagttttttaccatttactttaactgctgaatacataggaggaacttgtgtaattggaccggtaaaacttttcatcgcatgatccacaacatcctcgctaagatcggattgagttagtggagttcttgaaatgacctctccactagaatcttctgtacttgtggcatatcctaaagtgatttctccttcataaattttgccactttctgtcatatattcaataacacgagtggcttttccaaccgcaattggtaaaaccccaacaacatctggatcaagagttccgccgtgtcctattttttttgtatgtaatatctttcgaagcttgaatacagcatcgtgtgatgtcattccagcttctttctttaaattaattattcctgtaatcatgttttatattatatcagtaaataagcggtaacacaaagaaaggagcgtaaaaacttacgctcttttggtatagtgctataaggatttatacctaatctaaatagtatgaaaagcctgtactaaccttcttgaaccctaggttttcataaaaatgataagcttcctgacgatattcttttaaactgctatttaaagccagtacttcacttccatctgttttagctagctgtttaacgtgattaataagttgactagcgatgcctttacgacggtgcttttcattaactactagtgctaaaatacgatagtaagtcccacttttttcaaaaaagtaaagtttatgatatccaacgaaggcgaggagtttgccattatcctcagctatcaaaaagccataatctgaatgagtaagaataacctttaaaatagattgaatctctgataatgatattgcgtatcctaattcttgatacaaagggactaatttttcactatcgtctagtgtagcagttctaatcttcataatcataacctcttagtcttttagagcatcgaattttgctttcattgttggattttttcttgttaatttcttgacagaaacatcgtctaatttattatttgcaagacgtagttgattttcagacgttgttaaagcagccttaacagcttccatacgtttaatagatttatctatttcatcgattgctttctggaaatttttgcttgcagaattataatttttagcaaatgcatttttgaaaatatctaaatcttcttcaaaatgtgtgatgtcaatattttgttctttcatcaaagcaagctcttgtttatattttaaggtattgagtgctgcatttcttagaataccaattaattggataaaaaattgtggacgtataacgtacattttagggtatttgtgactaacatcaacaattccagtattataatagtcattgtctgcttcaagcatagttactaaaactgcgtattcgcaagatttttcacgacgatctttatctaattctttgaaaaaatcttcatttttatgcttcttgatagtatcatcagactcatttttcatttcaaacatgatacttaaaaactcaaggtcattttcatccttttctcgatagataaagtccccctttgagccacgacttgataatgtattgtccttctcaaaataagcattaggaaaggccaaatgtcgcactttattaaattctgtttcagcataatgttctaaactttctcctactgctttagtagactgttgagctttgaagtttttatagaattctacttgttcattggctgcctttagttgtacttcataatcactttttactgaagctaaagctaaatctttttctttttcttgaatgtgcaactgattttgtattgcatctctttctcgttcgacttttgttagcgcctcttgcaagctattttcatgctctaaacgtagtctatcgatttggttttcaaggtcgcgaagcatcatgtctttttgatttaattgctcagcgagttggtactcattgtctttgagaagattgtctttttctataagaaattgtttgactttgtactgaagtttagctatctccttgtctttttctacaacaacttcctgtaattgattttttgcttgctcccctaatattagacgttctttttccaaccgttcacttacttctttgtcaaaagcatctccgcgaatttgttctagtaattgatggtattcagactcgttgatggcaaaagctgttccacaatgagggcatttgatttcgttcatgataactcttcctatgatgttttgtatttggttctagctaagttgttgtctgatgtcattttggatacgttcccactcctgctctgcacgtgctatcttacgtttgtaatcgttgagcccctgtttataacgttggataagataatcctgtctaaaaagcgggatacttggtattgcaatatttaacagttcctttgtgctaatattcatcacagcttttcctttgttagcattctcaagtgcctgttgaccttcttctgaatcaaaaaaaagctttaagtagtaccctctaatgtgttgtgtaggccttagtattgtaatattagcagaggcaacgacagggtaatcttgctcttcaaaaatagcaactttcttgacagttccttttgaagcgattaaaacatcgccttcctgaagtagatattttaaaagcgatcgttgttcatcttggaatgttcttaagttatggtagtcaattcctaaaggagacatatcactcaaattaataatacggatatcacctgcttctgcttttgaaggcacagctttacctttaaagcagtctaccaattcagataataaataagtttttttctctgggttacttgttggattttgtggcacaatagactcctttcgtctttaaaatattatatcacaaaacatagttttttaatactaaaataaaaaataagctttcagtaagagaagcttatttagattaaatctattagtcgtaaggaaaattcgatttttgataaagccaataacatgctacgataagaacaatactggtaatcatgcttccttccacaccaaattttccaccgctaatccagtcagcaccataggttttaacatggactagggagttagacaacattggctctccactaacttcgattccaaagacactcccttgtacacagttccaggcgccatgaataccacacgccccccagatgttaccttttaaaataacatagagcgatagaaatagtccaaagagacacagattgaaaatcgagataaggcttacatgattattagcgctatgcagaagaccgaaaaagattgaactgatactgacagaaactatcttactatactttgtggcactcaccggaagtaaccatccacgacacaatatttcaacagatgcgctttgtacctgccatccaacagcaaaaataagaaaccaaatcaatttatcagctgtaaaacgaacagtttcgataactccagagcctgaaattattgttaatattaagcaggctccaaagagaacgctcccgactaaccatcctctagataattctgttagggctccttctttaaatagccctagagaactaattggacgcttctctttaaatttcacccacataaataacattaccgtactaattgaagttgctagtaaaatgattaactggacgatatcgctatcccactctagtttccaaaaatcaagcgagataatcaattcaataataatataggtaaggaaatctgctgtaaatagtaatatcaaagccaataatatagttaaaaggacatgccttgatactttaccttttgcagtttcctcaaaaatagactctctcataaatatctcacttttatctaactttatactgttatattatacaattaagattacttgctgtcaatcgttatcgaaaagattagaaaagataatctttattataaactaatctactgatttcaaggcatctaacatattgagtttttttaattgatggttaactataaaacctagacttattagaatgatgactactacgcttattggtattataaatgtagttggtgatactttttcaccaaaaagtatttgatctgaaccaattagcaacatcatttgacggtgtaaataagtaccgctaatggtgcctagaatcacaccgatggttgataaaataatggtttcgcggtaaatgtataaagttacttcttcattataaaaacctaatacctttatagttgatagctcccgcttacgttctgctaaattaatattagtgagattatagagaattacaatggctaacaataaagatacgacaactaaaatagtcatagagccatctaaagaacgcacaacggcttctacactagccagctgaagagcattttgcgtaagagactcaactccattaatttctaaaagtttttctgctaagttatttgcgattttatgtttggttaacttaaccaaaaaagcgttatctttagcttctttcttaaaaatagttcgatagtattgttttgtcataaaaatatagtgaccaacattcgcattgacaactcctgttatttttaattttctagaaggaagtgtttgtgaatgagataaatggataaaatcaccggtattaacatgataaaattgagctaattttttagaaataataatccctttattattcaagtgcaatgacttattagttgttgcttcttgtaaataaataaaaggtagtaattgttttttgtctgttatgaatagggaaattgactgtttattaatttgtccaggaatggattcgtcaagattttcaaggtgtattggttggtatttgtctatttttgaatcttttgaaagtagttcaagtatttttgggggagaagcatttgtgttatatgttagcaatatatcatagggcataatacgaccgaaatgttcattgacggtttgctttaaggaggattgtattcctagacctgaaaataagagcgctactgatccagcaactccaaatatggtcataatcatcctttgtttgtaacgaaaaatatttctagcagttactttttgtgtgaaggacagttttttccaaatccaattgatatactctaaagctattttagatcctttagctggtggttttggtaataataaaaatgctgctttttctttcaactcacgtcgagtgataacaaaaactggaagaacaatgcttaataatgaaaaaacaaaggctagtaaactgtaatttaagaaaagatgatactgtgtgtttggaatagtcaggtctttggaaatgatatcagaaataatacgaggtaaaagataatgccctccaatgatacccaaagtagtccctaatgttcctgctataaaaccataaataataaatttaaagataacttggcggtcactatagcctagtgcttttaatatgcctgcgttggttctttcttcctcgacgaacctagtcattgttgttaaggttactaatgctgcgactaaatataaaataatggggaaaagattactgattttagaagtgctatttgtactggagtcaaaagtgttatatccttgtcctccaggaaaggtagtacggttgtagacaataatttgaggcgattccattatttgggtgttatgtctcaattttagaagctcttttgttcgtttcaaaagagatagtcggtcttgtttaattttcatttgaatagcttgtctttgagatagtggcatcgctaggctatcattatctaaccgattgatttgtttttgagcttttagtaggcttttttcctcctcatcgattttacgtaggctctctttttttgttttggtatatcttattttattgtgaatatttaattttcgcgataccttttcttggtatttcgctactttttctttgtaacttattgagaaagggttaatcaacctaagatctttaaaagttacccttgccattgtatatactggagagtgaaatgctgtcttatctaatacgccataactatctaagtcgccgtcccctgtttgagaactaccaaggtttgtcttagaccaaatctcggtagaattaacaaaacctacaatagttagaggacctgtatttgaaaacagtttgtttttatcttgtttaaaattaattttatcacctattgcatatttttttcgttcctgaaatgagagagcaatttctgatttatttaaagggagacgtcccttaacaagatcaaaggttgatatcgttttggtattggaatacaatcgataagatttactattctgttgaggggttgtatctacaaagtaagaaaattcaacttgtgatccttttaagctttctaaaacagtttgatcatgtttgtcaagtccccaagaattgaaaacggtaatatccataacatgatgatgagcaaggtaattttgtgctgttctttgcatattaggtgctgagaccttcagtcctataaaagcaaatgagcctaacatcataagtaagaggattgatgaaaatctaccttttgaagtcgtaattgatcgatagatatctttccaaaatgtctttcccatctgtataacctctaatattctatgttctgaatatcacttggattctcgtttattacaatatcactgatttttgaatcatgcatatggatcacgcgatttgcaattggcgctaaggcagtattatgagtaacaatgatcacagttgtttcttttgattgcgccatcttttgcaggatggctagtacttgttttccagtttggtaatctaaagcaccagtaggttcatcacaaagtaacagtttaggttttttggcaatagctcgtgctattgcaacgcgttgctgttcgccaccggaaagctgtgctggaaaatgattgatacggtgtcccaaacctacgttttctaatgcctgttgggcatctaatgcctttggaacaatttctgaagccaattctacattctctagtgctgttagattagggactaagttatagaattgaaaaacaaacccgacatcatatctacggtaacgagtcaattccctgatggtataattagcaatattcttaccatcaattaaaacttcaccttcactattactatccatccctcctagtatattgagaacagtagatttgccagcgccggatgcaccaagaataaccaccaactcacctctttcaatactgaaactaatatcattgttagcaacaatttcggtttcacctgtttgataacgcttataggaatgcttcatttcaatataggacataacggcacctcacactatgaatacacctatattatagcacttttttattaattctcccataaaaataaatacataaattaagttatgtaaaataataatttttttaaaaatctgagctaaacactcagattccactttatttaattttctcttcttggtagtcgcatttttcatttgagcaaacaacttgtttaccaccaccgcgtacttttttctccactaagaaatcatttgatttggggcaagttcgtccaataggtttgtcccaagatgtaaactcacattctgggtagcggtcacagccataaaagatacgattgcgttttgtttttcgctcaataacttgtcctttttgacagataggacaaataacacctatttccttagtgatagcttttgtgttatgacattcagggaaattgctacacgcataaaactttccataacgtcctagttttattaccattggtgatccacatagctcgcaatcaaatccagcaggttcatcctttatttgaattttctccatttcagtttctgcttttgcaagttctttttcaaatggtttataaaattcatcgataatcttttgccactgctctttaccaatctcaacttcgtctagtttcccttccatttcggcagtgaaggtaacatcaacaatatctgggaaaaattctacaataaggctattaacaatttcaccaagttcagttggttcgaagcgtttagctgcaagcttaacataataacgtttttgaatagtctcaagcgttggggcataagttgaaggacgacctacaccgttttcttcaagtgttttaatgagacttgcttctgaaaaccttgcaggaggttgagtgaagtgttgttcaggattcgtattaacctttttaacactttctccttcctccatatctggtaacattttatttttgtcagtatcgttataaacagccatgtaaccatcaaacttgacttggctaccattagcaataaaagtaacaccattttgcgttaaattaactttcattgtgtcaaagactgctgctgtcatttggcttgcaataaaacggttccagataagagtgtaaagttttagttgatctttgtctaaatacttagcaatactttcgggtgtatgattaacactagatgggcgaatagcttcgtgagcgtcttgtgctccagaagcatttttaactttattcccatgtttagaataatttgcaccaaaacggttagtaataaattctgttgcttcattttgtgctaacggactaatacgtgtagaatcagtacgcatataggtaatcagaccttgatgacctgctgtgcctaagctaagtccttcgtacagctgttgcgcaatcatcatggttttacgagttcgaaaattgattttattagctgcatcttgttgcaatgaagaagttgtatacggtaatggtgcattacgacgacgctcttttttttcaactttttcaactaagaattcatcagttttaatacgttttagaactgttttgacgtcttcattattcgataatttgaatttctttccgtctaaaccgtagaaagtggcattgaatttacgtgttccttttttaaaggaaccgtcaatagtccaatactcctccggttggaaagccttaatctcattttcacgatcaatgattagtttaagagcaactgattgtacacgtccagctgataggcctttttttacttttttccataaaataggtgagatagaataaccaacaatgcgatctaaaacacgtcgtgcttgctgagcatcaacgagatccatgttaatctgacgaggttccacaaaagcatttttaacagcatcttttgtgatttcattgaaaacaacacggtttctgtcttctttgtctaaatctaaaatatgcgctaaatgccaggaaatagcttctccttcacggtccgggtcactcgcgaggtaaacttttttagcctttttagcttctttttttaaatcattaatgagaggtcctttaccacgaatattaatatattgtggttcgtaattattctcaaaatcaatggacatacttgacttttttaaatcacggatatgacctactgaggctacaactttatagttacgtcctaagtatttttcgatagtctttgcttttgcaggagactccacaataactagattttttttagcagtagctgatttttttttacttgtttttttggtcgacgtttttgtcgtagttgccataggtatcactttctatatcgtaaacttatagcataataactcacttttcttaaactgtcaatagaaaacttctcctatagtagaaagcaaaacactactgatattcagaaaggatatcttttcctgaaataatgcatttagctccttcttggataagatggtggcatccatctgatttgccatcgataatatttccgggaatggcaaaaacttctcgtccctcttctaatgctctttcacaggtaattaaacttccagatctcatcttagcttcggcaaccacaataccttgacacagccctgcaataatacggttacgttcggggaaatgaaatttcaagggttgttctccggtaaaatattctgataatacgagatgattatatgacatatattcttgaagtttcttattctccgttggataataaacatctaaaccactcccgataacagctatactactgccgccattttttaaagcactaacatgtgctgctgtatcaatgccacgcgctaaaccacttacgataacaaattgattgttagtctccttgataatctttttaacagactgacaacctatctgagatgcctgtcttgcccccactacagctaatttaggtttagatagaagttcaatattaccctgataaaaaagtagaactggtggattatatatttcttttaactctaaaggatagttagaatccaaaatcgatagaactggaaattttttgaattcttgtcgaagttttttaaggtctagctgtttataattttctataaagaaagtaggatttttacattttgatactacggccatattgcgaacagatagagaagttaaactattctttttgagatagttgataatattgtggatattaagatttgttaatccagcttttttaagcttaaatagttcaaaatgattcataaggttacctccattgactatattcgaaaataatagacaaaataaagtgataagatcaatctatactctgaagcattgataatagctattttttcaaaaaaataagactaggatttttcctagcctttgacaaaaaattaacgattatcaacaaagttctgtacatctttaatcatacggagtgttactcggcttccgcctgaattgatataccaatcttttccatctacctcatgaacacgtttgtttttgacagcatcagttgctttaataacatcgttattaaaaagttcttttgatgaagctccttgtccaatagtcgctccacgatctaaaacaaagagatagttaggatttttttcagcgatgtattcataagatacgggagtaccatgtgaacttagtttttcattttcattgactgctttaaatccacctacagagaaaatccaaccaaaacgaccagaaggtgattgagttaaaagttcaccgctgtttgccattacaaatagagctgtaggtttaccttttttctcaatagttttctgcaatttaagaacagcttgtgcgatatctttattaaaggtttttgcctttttattttggtcgaagattttccctaacattgtgacacgctcagcaactcctttgtcaaatactttttttgagtcgactccagcatatactaatgctgctttaggtgcagcctcctttaatttttcaatattatcaacagaagccatacgtgctcctaggaaaaccacatcaggttgcatacgagcaatagcttcaaagtttggttcgaagagacttcctacgtcttggtatctcttagctttataaacagatttgacgttattgggcaataaacttagagcatttttagccttcgggataccaataacagatttttcagctcctaaagctgtgatagtatccaaagctcccatatcaaaaacaactacttttttgggttttaaaggaactttaagtgtctcgctgatttgctttttattatccggcttgtctcttttttcttttttaatatagaccgaatagttgttttttatggtaacagtttgtgatttttctttagctaaaacagcttgagaagtggttaagatagtgcatagtgctaatatagcaataataagtttttttgtcattaaataaaatctcctaaaatagataaaaactaaaaatgttatcctacataaatctctttatttacgttgtacaaaaaaggataattggtttaccatcaacagtttcgatacggataggcatatcaaataaatgagaaaggattttttcttgcataacatcttcgacagtcccacaagtcaccacttgtccttcttttaaagcgacaacattgtcagcgtagtgagttgcaaaattgatgtcgtgaataataatcactatagttttattaaactcatacgcatatcgtttgataagatccatcatttgaacagcatatttcatatctaaattgttgagtggctcatctaagcaaatatattgagtatcttgtgccattgtcattgcgataaaagctctttgaatttgacctccgctgaggttattaatgaactcgtcagctatatcgtttaaatccatataagatataactgattctatgacagctttatctttttgacttaaccgtcctttactataaggaaatctaccgaatcctatcaagtctctcacctttatcttgagtgttaagtgattagattgtcttaatatggctaatgttttggctaagtcatttgaactgtagtgggctaatggtactttatcaaggaaaatttcaccattatcataaggttcaagtcgactgatacaactcagcaatgtactctttccagatccatttggacctaaaatagctgttacttttcctttaggaatcgaaatattaatgtcttttaatatttccttttggccatagaacttatgtaaattgtttatttgaatcataagtttttccttcctttgattaaggtgaatataaaataacttcccccgataaggttgaggagaacacttagttgaacagtgaggtgtaatagattttgaacgagatgctgccctaagacaagtgtaaagatacagataacaatggctataggaactaatatttgatgtctaaaggtatgaaaactgtgataggtaatatgtgctacaagtaagcctaaaaaagtaatcggcccaactaatgctgttgctatagctaccatcaatgctaaccataaaaaaaatctagtagtaagcttttgatatgagatgccgagtgatatcgcattttctttacccaatagtaagacatccaattcctttataaaaggccaattaatgacaaagctaacgacaatgataatgaaagaaatccaaaggatcttggtgttaatagcattgaaactagcaaagagctgattttgtaaaatcataaaatcgttggggtccataatggcttgaataaaggatgagatagaagaaaataatgtattaaatatgagtccagctaatagaacaaaatacaaagactgttttttatttcgaaaaagtatcgtaaataataagtaagcaaatccaaccattaataataatgaaaggaggaagctactaaaagatgaaaattttatgacacgctgagctccgattaaatacattaatcctgtttggataaggatatataagctatctaaaccaataatggacggagttaaaagtcggttattggttagagtttgaaaaataagactagaactaccaatgcagataccaaccaaaattaatgcaatcagtttttgataacgtgtttttaggatatagataatcaaaaattcatttgcgtcagttggaataccataaattaaaaacaaaataatagcagcaattagtagtatcagtaaaataagtaattttggtatctctaaatccttaatcatgattttccctcatttcttataattgaaatcaggaaaaaggcactacctaatactcctagcgtaactcctattgagacttcataaggaaaaataactaagcgaccaaaaagatcacatatcatgacgatacaagcccctaaaagcgatgtctctaagatagttgaggacatatgatctcctttagttatgctaattagattaggtacgattaaacctaagaaaggtaaagctcctacgataataatgactagggatgtcataattgaaaccaaaactaaaccaaagtaaatcatcttttcataagcaacccctaaattcttagcgaagctttctccaagcccaacaatggtaaactgatgagcaaaaaaatatactaaaaacaaacatggcaatgctaagtaaagaatttcgtagcgatggctagtcatgatggaaaaattaccttgaagccaactgttgacagattgtagtacttgaaaatgtgttcctaaaaatactgttgctgctgctacaatttgtccaagcatcagtccgataagaggtataaaaatattatccttaaaagtaatcatttttaaaatggttacaaaaagaagcgatcctaaaatggcaaaacctgaagctatacatagttgaataaaaatagaggtatttttaaagaaaatcagcgtaacaactactcctaatttcgcccaatccatagtccctgaagttgtcggtgaaacgaacttgttttgggttagttgttgcatcagcaggccacagactgacaaacttgcaccagatattaggatactaatggttcttggtaagcgactcgttaaaaaaatatctacctgtgattgatcaaggtgtgttatttgctccagtgggatagatttcacaccaacaaatagggacgttagagaaagtataaccaaagtacaacccattacaggagtggttaatagctttttcataaaactccttaaaatgaaagataaagtgttcaaaaatgagcacaaaactataataacataattttttggaaaaatatctactttttaaagaattttatacttaagaaaacattattatatcaaggtttttctatttaaaatcattataaataagatagattaaattagcagaatatttactttacctatttttgaaattagaaaaaaaccttcgttataattaaaggtttttctaattttaagctaattttttgattatcttagcagggtttcctgctataacaacgttattttcaaatgatttcgtaacgacacttccagcgccaacgacgacattatctcctaatacaacacctggtaaaatagtcactcctccacctagccagacattattcccgatttggattggggcaccgtattctaatcctgaatttctttctattggatctagaggatggagtggggtgaggagttgacagtttgggccaaacatacagttatcgccaatacgaatttcacaaacatctaagaaagtttggttaaaattggcgtagaagttttcaccaacataaatattacaaccataatcgcagacaaaacgttgttccatatggatactcttcccagtagcaccaaaccatttttgtaaaatgacgttacgtttgctactattatcttcattgttaaaggcttgcatattttttagtgcaacttctctatccttgcgtagttcaggtgctgatggacgataatattgtcctgctaacattttttctttttcggtcatcttttcctcttccgtattatttacaacattgattttataggttcaaaacttttacgatgtatcggagtaataccgtatttttgcaaaccttctaaatgctctttagtaccatagccagcatttttagaaaatgcatatccaggatatgtgctatcataatcagacattattttatctctggtcactttagctacgattgaagctgctgcaatagagagtgaattagcatcacctttgataattttagtttgtggaattgatagatctaaaaccatagcatcaattaaaagatgttcaggagccacagataaatgagaaactgcatcaatcatagcatgttttgtagcttcataaatgttgatatcatcaatacattggctgtcttgaataccaataccaactgctaacgcttgatctaaaatattttgatagatttcttgatgctttttctttggaatttttttggagtcattgagatgttttattttacagtttggtggaagaataacagcagcagctactactggtcccgctaaaggacctctacctacttcatcgattcctgcaataaggtttatatgttcaatgtaaagttttttttcgtagaccaacatttgttctaagcgcgcttcttcgtctaaatctgactgaatatttttttttcgttgaaggattgctttttgaacacctgcgcgtgaatctgtttgatattcttgccaacgtttgtcttttaaatcaacaatagtctctaaaattgctttgatttctttaattgttgccatcatgttctccgacgatatctaacgtatagcgtcctaatttaccatcgcgaacttctttgacaaataaattataaaagcgatcgtaatcgtcacgataacctaatttttgtgttaaggccatgatgatttcaggagcttcatcctctaaattaatgcttttaaaacgctctttgagacgatcaggataataggttttaaagtaattcaatccaaatattgttacctcatccataggcaataattgatctttgattgcccctgttaatgctagctttaatccaactaattcatcttcaaatttgggccacaagataccaggagtgtccaaaatttccagttccttattagatttgagccattgctgaccttttgtgacacctggtttattaccaaccactgcaatttttttacctgctaggcgattcattagagtcgatttacctgcattcggaattccaataatcatcgtacgaagtgtctctttttgaataccacgtccccgtagattagcaattttatcggacattaatattttagcgatgtcggttacttttttaactgttgattgttctttagaattaatagctaatgtctttaaaccttgagattcataaaaatctctccattctttagttcgaataggatctgctagatcagctttattgaggatcattagtttgggtttgtctccgacgattttggttagcattggattttgactagaaagaggtaaccttgcatccactaaaattgtaacaaaatcaacatgcttaatattttcttgaacttgacggcgagctttggacatgtgtcctgggaaccattgaatagtagccatgaaataaattctccttatgtatagactaccttaaaagtctacatctatttgttagaggtctaattttttagttttattctttttcaaccgcatataaaggtcgataaaatattcgattaacactattattctatcatttttttaatgatatcgaaatactttatacatttattccgctgataggtttcgtttactaattgagtttaagggatatacgaaaaagctctggaagtttactccgagcttttaataacatgatttttaccacattaagactatttgatggtaacagtcgttccttgaggaatattttcatagaaccattttgcatccgcccttgacatacgcacacagccatgtgaggcggcttttcctaattgctttgcttcttctggaatctcatttccttgttgatcagtcggaacgctatgaaagagataaataccatgttctttaaaggagacccaataataggctccttcttttgatgaggcgttatagaaaaaatctcctcgttccggttctatgacaaaagttccttttggggtagggctctcttttgctcctgttgaaacaatcgttttaaagatgaccttgtcattcgaggttattgtcattgtttgcctcgtagatgaaacatgaatttctagatttgaatatttatttagatttggataagtcttcttttgtaagacctctttttttgaagtttgacttgtttgagatgcttgttttatgacacttgctttttctttggctttatcaccacgaaaaatagaatatacgctaaagatactcatgaaaacaaataagacagctaatattggcaaaattgaacgttttctcatgtactatcctctctcttttgctctgttatggacaaatctattataagtttctgaaagaaggttgtcaaatatttttgtaacatttgtaatcaaacagaaatatttactggaatttttagtagaaaaataacctcgaatgatacttcattcgaggttattgtgataactgtaagtcttaataacatggcttcaaaataatattaagaatctaaactactgtaataattaattggtctatgatcgttaaacaggaatgcttcaggatgaacagtttttaattgtttttgaccagatttccagaaaagtccaacaagaatacctgttaacactaaagcaagtgaataagttaagatgcctaagcccatattaaatccaattggttgagataaaatataaacaactactgcatacaacatgaacatagctggtacaaatgttacccaataatttcgtctttttaggatgagatatcttgtagcaactaataaaccaataacagcagttacttgatttgcccagttaaagtaacgccataggagattaaaatcaacgtgtgtaaggacaaatgaaataacatataatgggatagttacagcaaagatttttggaagagtatcttgtttgacatggatataatcagcaacgatagtacgtaagctacggaaagctgataaaccagatgaaacagggagaacaataacaccaatgatagcgatagttccaattacactaccgagtaacattaacattacttgattgacaactgcagaaggtgtcccagcagcaatcatttcatagagattttgacctttgaacaagctcattgaagcacctgcccaaatcatcgcaattactccttctgcaatcatcatgccgtagaaagtgaaacgcccttctctctcattaacagttgttcttgagaccataggtgcttgggtagcatggaaaccagagatggctccacatgaaatggtaaagaataaagcagggaatatcccaagcccagctggatgcatatttttaaaggtttcaaaagttaagtttggcatatcaaagccaccagttaataaacggaagccaactgctgccgtactaaccattaagatgacgcagaatacaggataaactttaccaagtgctttatcaataggtaagactgtagaaataaggtaataaacgaaaataagaccgattatccaaggtaaagatagtgtcccagctggtaaaatacttaggataagattagctggagttaccacaaatacggttgcaactaaaataagtaatagcattgaaaaaatgttgatcacatgcttcattgactttccaagatagcgactagctaattcaggaagatatgcaccattatttctaagagaaatcattccaatcatataatcatgaacagcccctgcaaaaatacatcctaagactatccagatataagcaactggaccatagagtgctcctaaaatagggccaaagataggtccggttcctgcgatgttcaataactcaatcatcccattcttccattttggcataggaacaaaatcatatccatcccttaatgcttctgcaggtgtttggcgattttcatcaatttgaaaattcttttcaatgtatctaccgtacgtgaaataaccaacaattaaaagggctacccctcctaaaaatgttaccatatcactgcctcctaaaaatttttttgcttaattttattaagcgttttcatgactttagtatagcattgaaaaattgaaatttcctattttcaagatgaatggttgttttttagaaatgaatagtctaagttttatgatgaataacttttcattagttaggtagatatgcctaacatttgttttaggggttttacatttgctctgctaacaggaactgttattttattacaaaggtgtaactgaagtgtttggttaaaccaaggttcaatcgttttaatagcattaatgttcacaatgtaagagcgatgtacccgtacaaattgagatgatggtagtttatcttgccattgttgtagagagccatcaatttcataatttttatcaggtgtttgtataatcagttttccttgcatagcttcaatcaaaaggatatcatccgccgacaccagatagattcgatcttctactgtcaatggatactgttgcttgaagagaggaccggaagttacgctctctataattgtagatgtacttagcgctccttttactctatccatagcttgctttagcctatcaaaatcatagggttttaacaaataatcacgcgcatcatgctcaaaagcctgaatagcatattgatcataagcagtcgcaaatatcaataatggtggtttgggcattttattgatatactctgctaattgcaacccagaatcatctctgagatggatatctaacagtgctacatcaaaagtttctctaagtaaaatagctaatgcagtagccatatcatgcgcctctgctataacgaggttagaatcatacttattaagaaggtaaattaattcgttacgtgcaactggttcatcatcaactactaaaactttcatacaatacctttctaatttttaatggggatattaacaatagcacaagttcctgaatcatttgattcaaattttaaacttgcttgtccatcataaataatattcaagcgacgaacgagattctcaatagctgtaccagaaccttgttttgaaatttgagttttttttccaagcgttattaatttttcttttggaatcccaataccattgtcttggacaatgatatgaagcctatcattatttcttgcaatagtaacctttagctggttatttttattaacatgcttaaaagcgtgtttataagagttttcaatcaagacctgcaatgtaaagggaggaatcattaagttgtcatctgaatttgtttggttgtctaaattaaaggccaccatgttgggaaatcttgcttcttcaagggctaaataggcgttaacctgttccaattcatcatgaagaggaattaaattttgctttgcccgttgaagattagcacgaataaccttgctaaaatcttggacgagctttcttgctttttcgctatccatgcgaattaaaccataaatagtattaagtgcattaaaaagaaaatgcggattaacctgcgcttggagagacttcatttccgcatcctgtagtaaccttgttgcttcctcagcttgtcccaaagctaactgagtggaaaagatattgcctaatccttcagctaattgacggtcaacgtaagtcatatgttgtgcgtctgaaaaatataatttcaaagtacccactataacatcgtggatgtgtaatggaataacaattgctgaactaagtgggcaattcttatggtcgcattcgatttcacttttatcagttgcgacactaactttaccagtatctattgctcttttagcaagctttgttaatatttgagtattaggaagatgatggtcagctccatctcctacataggctaaaatggctgattgactagtcaggctaacagcactcacatccatatgtttatgaataatttcagctactggttgacaagattctgttgtcagtccctttctaaggtaaggaagggttaaatttgctaattcaagtacttgatgggtttgaaatgctttagcatgttcttctaatttttgagtagatgaaataatggatataaatatacctaaacctaaagtattacttaaaatcattggcatgctgataaaagatactaagcgaagcgcctgattaaagtcaacactaaaaatgaggatacagatcatttgtagaatttccataccgaaaccaacaaccattgcatctaaaacacgaattttattataatttttacgaagataattgcctgataatccagagcataaaccaattagtaaggaagaaatgacataaatatgaggggctaatcctccttgcaaatacctaacgaatacagataagagaccaactataataccgactatggggccaccgattagacctgatacaccaatggttaaaacacgtgtattggcaaccgatgattgatctgctatatgattaagagtttgtggaatgatagataaatctgactgaatttctacccctgtaaaattagaaataatagcaaataagctaaataagataagcagaatatactggtgtttttttaattcgggttgcttcaaagtttgttttataaaggggatatgcacaaaggcataggctaataatatgattaaccccgctcgctccatcataattaaaaagagtgtcattaaatctctccaaagtattaattagtccgttataacataggtataaaatgattcatttcattactcatttaaaatgtctctctatcaagtattctcaagacaattaaggggatatccatcaacaactattatgaaaacaactacttaaggataatagatactttcactaaaaaattttgattaatcaaatatattattattatagcatatcaaatattattttttacatatttattaattaatatgtaacacccattatctgaagtgtgtaggtgaggtctaagtaaagaatttaagcgttttgataataaaaaagtgagaacaatagattctcactcacaattagcctggtaatttctcacacgatttggtactgctttttaaaattgggcgatggtgttatttttaatatgagtagctgcactcgaatccgattgctcaaaagcacttgccgctccattgagatagctattcagatcagaaataactggttgaatgttttggctgacttctttgataacttttgatccagcttctaagtattttcaatgttcttgaacccattggtgattttttttactaagtcacatgctgttaaaatcatcattaagcttatccctcccataataataatcaattttttaaatcctttaaacatcacttttcctcttatcttattgattttttcaattttattgctgtcttgacgttgctatcgcaaacaaccaactcaatgcaatatagttatggtatacatatcaatgtaagaatcaagatttttaaattcatattatttgtatgatattcaggattagctatttttgatttcacaaaaaaacttcttctactttttctagactgattctttcttcccactccttcgtatcaatagttaaacaaagtactttaaatcctacagagggtcattccatcaattaatggtatcatcgcgcttgaagcatggcataggttttggtattagaaactgaatatgaattctattatctgttaaaaaaatcaatatcaccagagtatttataaaacataacgataaaaaatcaaaaaatatttttactatttcccttaatttcatgagatttaatttccctttttgtgtattatttctattctacactagtcttacccttagaaatatttttccaattttcaatgacacgagctactctttcttgctcttcgtcatggtacctccaaaaattacttcatcaatatcttcctcattgaaataatatacttgttctaaattgagctctctggaaaaatcctgccagataatcaaaatatcatcttgatcaataatatttgctcatgaaatggctccacaaaatttcttacatctttaacattttcatagagtgcttttactccacaatggccaaagtacctataacaactgctactactggtacaaattggagctgttatgattactacaaaaacactctcagcaagcgtagagactattctacctacttcattttttctagatatttattgctcctaccttaaattaattaatttatcactcatattcgggatgcttatgaatataatatgctgcataaagggaatcgacaatcagagctggaaaagttgccgtaaataatacacctccaatcaaaccaaaaatattttcaatactacctacaagaaagactggagaaagcatcactaaaccaaaaataattccataattaatttttaattgttccttttttcctttttgtaatttccactgattaaatttccattttttcccctgattttttggtaaataatagaaataatatattccagaaaatacaataaaaataattaacattatcataatatacatttttgccatctcagtataataaattgattgaacatgtccaaaatttctattatttaaaaacattgccaagcctataaaatcaaaacctataataagtgttaggaatactaatgataataaaatataagaaattttttttaaaaaattagatatttttttaaaaaaaagcgaaataattattgagaccaaattaacaaaaatgcatacagaaaatatgaattttataaaacctaaaggatcaccaaaattacttgcatataaccctatgcaagatataaatagtccaatccatggaaaaattttaatatatgaatattctatttcaaactcaattaacggtccatgatatctatggttgctctgtttcaaaaattttaccctccaaataaatcttttaatccttttttagcaaaacctgtaattgattcattacccaactccttaactttaaaattcaaagcaaaatcaaatgccagccctgcactgctccaacaacggttcccacaggtcctcctaccaaagttcctattgctgcaccggacaatgcatctacacctgaatctatagcaaagtttttgattttttgatctagtgtagaagtcttatcatcaaaaaagtcttttttggcattagtttctatattgactattttcccagtccaacctaatactttaccagctttagcaattcttcctaattttccccatcctttaaaagcatttttgggatttaattcaaggacttcatttttaagggattttattgctgcattattcaaagtaactccttttgacgcaatttttctgagcttatttgaatcttctaaagcttttttctcaactgtttagcatcttcttctcgttttttcatacctgtttgaattgtttttgtccattctaatcccttacctgaggtatcaaatgtaccatttaaatttccaaaaccttctgagaatagttaaggcctgccgaaacgacatcctgaacttctgttagtccacaaaagactgttgaggattccgcattgaattccatgagatattttttaaatcataggttacctttaatgccagaaaactcctaagagatttcatgaactagctgtcactttataagtgatcacaagctaataacaaaagtgaaatgaatcattaacttttctaaagttaataaagaatggaattagctcaattgccactctagaagcgagaaagtcaccataagaatgacctgttgtgacagtaatattatcgccattactttgaacacgatcataaaagctagtagctttgtctcctaatcgttttaaataagcagagttattagcaccgatatttgcatctgaaataaagtcggttgccccatcagcatccttattagtacccgcataagctatataagtctcaccagtatttttatcttttacagcaatagctgcaataccagtctctttgtcatacataccgtcactataagttaaatcagttctatcaattagttgatttaactcttttttagtactttcacttgcttcttttatgtcatcaccattatttaaagcatctgtataagccctctcatatttgtatacataatctgataaatctgctgatgttttaacccgatgttctagttttatagttacattatcatttcccataacttctccgtttattttctaaaactataggtctcacccaaatagtatctcttgtttttagtttttatccttagtgtatagtcaaaattattttttccactttttgtaaaagtaatatctgcttccttaatatcagatattttaaatttatctctcattttttaataagcttcgactgtgtcggcaattcatatgttatatctttcaactcagtttccggatgttttaataaataactttttacttttaatttttttaattcttttaattctttagtatccattgctccgataataaagtcatcaaatgtaatattcggttttccttttggataaactatattatttttaaaatattcaaatgggacctctttattttctaactcattatagccacccggcttttctatttgactttttcttgtttcaaacttccctaaatccttatttttttttaaatcttgaatactatagaaatattctaaatctaatgcatcacctgaatccgatactaatagtaagtatttttgtattttgctcaaatctttatctttttgtgctaaaaactcaaaaaacggtttaaaattttgttcagcttggtactcttcctttgtgcggttttctgggatttttgaatccttacatgctgtcatcattatcattattaataagcctccaataagcagtaatagtttttgttttttcatatgctcaatgctccatttctatttcttgagtgattttaagcattctttcttgtcttctatcatgaatataaatcatatctggtttcaaataaggttcttttgaattatatgatttcggtaatactgactgatccataactctcattcctaagagaacatactgtgcctgtgttctaatagcttttggaacatctgagatattagtcataaggtatgatgctaaaccaccaaataagaaataaatatgatatttgtgagccgagtcaagtaagaataaaatctgttctctatccatatttgtttctgccacaaaactattcatatcaggaatagtaacaaaccatgattctattttaccagattcttctattaaatagatttctgaaacaatagcttctaaatgccctgctatttcacttcgattattgatatattcaatttgttgttctgtcaaatcatcataatcagaagcagtgtctaaaagataaacttactatctttaatcaatgaaacagatttaactaagaagcgcatcaagttagacaaattatctggattgtcagaagtaaaaagtaactgtttgaatttcgaaagtggaatgctacaattatcaacttcttttaagctaataccaagtgaaatctgattagtctcacttgcttttttaacatcctcatatgctttaaactcctcaaaggtaagtgtttctggaacaattggaatggctattggtctcggtccagtccatttggtgataaaaatctgttgattttaaagttcttatgaaagataaaagggtcttagattttgacaagctaagaaccttttgtttttcaaagaataattatctacttctccccaactacataagtcaattgtgctgcttctgctgcactgaaggtgcggtaggagatggtgccaagtcctaggacatttgattcggagatcgggatagatccgtcttccttaacgtcttcgacgatggccacgtggccgtaagttctatcagcaccagcttggccggggctaaatgagatggcgtagcctgtttttgcctcgtgtgtggtttgatagcccggcttatttttccaatcgccaccattacccataaatggtccaaactggtagccaagttctttggccccaagggtaagtgcctgccacatagttgcccgcttgattagctcttgaaacagagtaactcgttgggactgccatcatagcgacggacgacgtgttgagcagttcctttgaaatctcagaaattccgccatgcgcgtcaatccacttgtcaatgctctccataatggccgcacgacgtttaccagaaccgctagcatccgtgaagtaaaccccacctcgagccgctacattcaagttgccagttgacaagaattgtgctttttggtcttgaatggcaaagctggtgttttggttttggatgatggtttcctgcgtcattttaatgacagccttgtcatcactaaagttttgagcgttagttgtattgttgtcaactgccccaaaaccaaacatattagcacctggtgctgtggcaacgccttgtgtaccaagcgaactttctgcgatagcaatggcaatgattgcacgcgcatccagaccagatgatttctctcggtctaagattttttgaccgtcgatgcgactgctatcgtatgtgatacctgtcgactgtaagaatccatcaagctgtgcggcagtaatgccgtaacggtgagacaatagattgtgtgtataagcatcattgcctatccagtgtttgacataagctgcgctagccattgccgtaggtatggcaacatctggcaaatcaatgccactcgtaatggctggtgtcacaacttcagatttctgaggtgttgctgtcacttgaggttggcttggcaccactggtgttacagactgactaggagctggagtttcgggtttgcttgtatctgtttgcgtcccagcctgtgtttctcctttggaatcacttgttgaaggaactgtttatctggactagtcgtcggattagtttctgtttgtccctcaattacagtctcagtaggagctgttttgctatctgctggttgggcatggagatcagttgaaggcagacttgcctcaggtaccactgtcgtcgcttctgatgaaactgactcagaagcgcttgtcgcctcagctgatgaattttctccagctttttcaattgtttgatcagttacagtcgtagcttgcgtcaaaatagtttgtgcatcctgagcaaaaaccgtaacagccgataagtttgacgtggcaattgcacacaacaaacacaatgcaatatatttatcttttttcaaaacgtttttccttaatagtttatagagtgtttaaagaatttaatattaaaaattacttttcttttattcttcagatgactattttaaaacgtctactgaaaagtgagggtatttgatatcttttatttatttcaaaaatattttttgcatctcctcttcattttcatcatagtaaccttcaaacaagactttatctatatcttccaaattgaaaaaataagtttcatttccaactatactaattgggaaaatacatccagaataatcaaaatatcccaattgaccttcattgtcatataacggaaatcttgatgtaatcatgactttctgactatcattttttaattcaatgacacttcctagagtatgtattttatccattttttcttctatttttacaattaaaaattatattgcttttttatttcatttattgcattttttctttcaaaaaaatcaatattttctaataacaatcttgataatattagtaacataagtgctataggaaaaaatatcaatactgagtatttaaaatataacattattaggagtagggatataaataatgaaattactaataaaaataacagtttattcgacaattcttcagcagaaacaattatatttgctattttttctttgtcaaattccattttctcgtaactaatattatcgatatttctcttttgtttcgaaactatattgtttaatttgttaactactactagtgcaattacgataaacattattgcaagaattaaattcaactttaaattagctattgttctataccaattattaataggaatgagtatgagaacaagaaacgtaataatactagaatattttttaatattttctaaattttctttttgataattaggcgtttcaaaacttttaatgtaaaaaatttttgtatcaaaattataataataaccttgatttccgtcatgatatatttctgcatatgatttctctctatgtatcaaaataaattccttctcaatttatactacctgttgaatcatacattaattcaaaaaaatcactaacattgttaattgtatccttcgatgctctttttataatatgatttatttcatctttattatcataaacataatcgaacaccatcgatccacctacacctattactgctgtagcaccaaagtccacagcagaaccaacaacaggagcaggcggtgcaagtacacctgttgaaattaatagtccagctgttgcggtacccgcagccgttcctacaacttttgcagcactaccaattattacgggtgctcctgtcttcatagttgcatcttctacatcttctccaccttttacttgagctgctccaaagtcaattgcagccccaagtacaggcgctccatattttacaaattggctcgagcctctaatgaagttagcgtaagaaggatttacatcaatagccgagctgtgtcagtcaattttgatttagctacctctttaagtaaggcagccgatgcattacttaaaccactgataattgattcataggtatcttttttaatttctcctaatttatacgcttcattagccgcttttattaatttctttttatcaactgaaacattactttttttagtagtattttcaatttttgaagctttcttactttcttcagcctttttacttttcagttcttcagctttggcgtcttctcgctctttccaattcttcttaactgtctttgtccattccatctgtccggatgttggttttccaaaagctccggttttactattatatccagaaaatcctgttgaaacagccgctagtgcttggttaacagttgactgtgcattagaaatgtccgcaaatactgttgctgaatgggcgttaaattcattaaggttgtctaatttcttttgattagattttatacgtttttttaattttttaatattactttttgtagaacttatggcagatttggaaggttctggatcatcgttaagatgctctaaaagtgcttcagcaatctttaatgatgccctatcacttgctaattttgattctaaaacgacagagtctaaatcctcatcaccacaaattgagacatataaggtttgtaattctgtacatttctcactcaatgtttcagagaaaagaatcattccttgaagcatcggagttaacgttccagtagcatagctttttgcatttgaataagcagtcccttgaagagttgcagcctctgcaaaagatgatagttttgttattgcatcatttaaagccgatacacgactaaacatagaaatagctactgttgatgcttgagttcctacagaacttacactaacttttaccatttttaacctccttttctttcattacttttttgcatcaaactctgtttttcataatacaacttatctaatgcattttcataatccataatctctttagaaactaagtttatcctattgtcataggattcttctaaacttagtgtttcactatttaccgttagaataaagtcattattctcttctaattcttctgattctgttaaataggcatcaccgagttttaatgattctagtaactctatttgtaactccatgacgtcgtttttcaatttttgtaagagccttttactattctcagcattatcaagctttatttggaataactttaagtcaagttcaatatcttcgaatgttcgttcagtcataacatcacctattaaaacaaaccatatttaggcttaaaatccggatttgatataacagagctgtcattactaggcattgtatatttagtatttgccgcaatctcttagctaattttttggtcaatagcttcaaactcattcaccgtagaatgaatgagagctatgaactcatttattttttcagcaatttggctactactacttgcctctccatcgatgtaagttgaagcatcgctattaccactataatcactgtttgaatccttagttggagctcctactgctgtgattccactggctcctgattgtattgcagttgcacaggtggatgcgacggaggcatcactttgtatttttgccatttggtctcctttcttagtctatggtgagttttaatttttgataggtttttctatcgtgaatgtaggcttcgtctttgtttggacggatttccttactattatacactttttcaaggaaggtttgatccatgagcctcatgccagccagcacatactgggtcgttgtgcgaacgtatttaggcacagcatcgatcttagtcccaacatagttatagcttgatccaagaatcagatgtaaaccatagcgtggtccattgtcaagcaatgcctgaacctgttcaagcttcatattgctcttagccacaaagctttcaaaatctggaatcatgataaaccattcagctatctcagattggctttcacgttgctgcaactcatagatcaactgatccgccatatcttcaatcatatcagaacccacataagtacgtacctgaccttgatagctttcatattcgccaagcgaatcgatgatcatgttatggtaatttgggacgttaagcaagaccttgatgatatgggaaccaactgcttcgagtgactcgtcagaatcagacatgtaaagcatatgcttaaagcgattaagtgctaaactataactttcaacgtcaaccatttcaagcccaagtggtaaacgattagctgataggtcagcttgaacactatctgtagccataaagtcgtcaaaggttaattcttcgggaacaattggtattgcttttggtcttggtccagtccatttgctgttcatggcgtcagattcgttttggatgttattgatgatgtcaaaggtttcagtgccttctgttgagagagccacttgtaacacttcaatgtcatcacgtttgattaatccacgtcctggaatatcttccatgatgtgttggtgacgaccgacaagtgtccgtgattcagagtcatctgttaatttaagagcgatacgttctttaaggtttgccattaaggacgacctcaaagctgccgtacgaccagctgagataactaaggaaatgccaagtgacgacccatcacgcgaaatattttggaaacaagcttctaagttagtcggtgtttgagcttcccgtagcccttcataactgtcaataacaatcaggatttgaggcatggtttccccagatacctgacggtaaagttttgctgtcgcgacattgtagcgactgagggcttttttacgatcagacatttcaactttgatacgggcaataaacttggctattttttcgtcatcatcaatggtaaagaaatctgctacatgtggcaaacgtcttagaggtaagaggccattggtaccaaaatcaaagaggtaaaggtttaaaaattctggactattatgacgtgctaagtccattgttacagtttgaagggctgtggatttccccatacttggtcctgcaaaaattgacaaatgcccatcgtcttcaaaatcgtggtaagccacttcttgtgcttgttggcttggtatatccataaagccaagaacagctttgtaagatggggccttgctccagaggtctactgatccctccttacggagatcggttactgcaatctgattgcttagaggcggtagccacggttgaggtaagtctgagatgcccatttctttggttaaagcttgaatgttttcaacgatagcatctaattccgtaggtacttctttaatattttcggcttggtctaagcctgaaagatcatcatttaggatttcgtattggccaaggtcgttgatggaataaatggtatggtcttcaatcccttggtcgtctttttcaggttggtaatctgctcctgaccatgctgattggaagagttcatagacttcattattaccaacttggaggtaggcacgtcctgcttgtgtaatctcggcggcatctggagtatggagcatttccatggagtcgccgcggtctgctactttaagagctagtttgaagcgtgagtttgaccagatttggtcatctaccacaccagatggtttttgggtcgctaggattaagtgaatccctagggaacgcccaattcgcgctgttgagacaagctctttcataaactcaggttggttggatttcaattcggcaaactcatcggagattaagaagagatgaggcattggttctgaaacttctccaagtttgtatttcttctgatactggttaatatgattaacatcagctttagcaaataaacgttgacgacgtttcaattcagcattaatagaaaccaaagcacgcatcgattgggcaccatctaagttggtgatggtgccaagtaagtgtggcaggtccttaaagaggtttgccatccccccacctttgtagtctatgagaaggaaagctacatcgtgtggatggaaattaacagctaaagaaaggatataggactgtataatttctgacttccctgatcccgttgttcctgcaactaatccatgaggaccatgagctttttcatgtaggtttagataaacaatatcatcctgaccacgtaagccaagtggaacagctgagcttttatacggagcatggcttatccaacgctcttgaacatgcaaatcttcaaattcttctgcttgatacatttccataaaagtaactgcttctggtattgaagatttaagattttgtaggtgatttaacggagctaggcgacgtgaaatattttccttgtcataatcctctaagaaatgatctaattcaaaatctgtttctttaagctctccttcttctataactaactgaccagtattacggtctttaatattaataatggttttgatattttctgaaagtgaactcataacatcttgaacaaagatgagagaacatcccaattctgtaggatcttccgtaaagaattccatgatgacgtgatctaaaattaacttttcatcagttacaataacgacataatgcggagaaaataaagtcccttctttggcagatttatcttcgcgttgtgtgcgacgtaattttaaaatttggttaagactgttgagcacttgatcacggcttctttgattataaacaaagccacgaacattgacatcttgtaaggtttcatgtggcaaccaacgcatccaagaccacttatccatctcttcctctggaacaatagtaataaattgaacatcatggtaagaatggaaaaaagctaattgattaaccatcaattggagttgctccaatactaaacctcgtggtcctatatagccaactggtccatgtgataaattcgcaacaatcggcatatttttaatataacgattgttaaagtagaggttatagccttcgttctctaaaggatcttttttcccagaacgttctggttgagaataatgaatattatagctcgttggtacttctcccaaacctaggcgataatacaagaagtcaaaatgaagtggtgtcttttcataaatacgatggtgataagtatcagccatttcctgtaaaccttcaatcgttgggtaatgatagtgttgcccacgcttttgctctttagctaacttctgaagttcaattgacttatcagataaatagtcatgataggaatcaatgcgttcttgtaagtcctgcttatactgtttacgatttttaaagtaaccagtgatagagaaaatcatcgtcactagagccattgacattgttgcaatgatatagataccacgaggacgaaaaatagaaataagaatgctgactccaatcatcactagaggaggaacaattaattttaacagttcatctttagacttattaggttcattaccaggcgcattaactgtaattttatcttcactggaacgataaataatacgaggtgagcggtgaaaatcaggatagccttcgtaaaattgataagctgacataactttcttagttaatgatgtttcataatcagcccccccagatttgaatttcatctgggaaaagcttaacaattgttccttggaagctaatctcatcacctaaacttaaaggtaactgctgcactactttttgaagatgattattcagataaatatcaccttcaaataaattaagctgccaattactttctatttttttcagtaataaattaggggctccttctttaaaacggacacgatacccttctttatcaccgattaatatatcttcgtaatctaagggagtataaatttctttttgattattcgctaaatagaagacaattcctgaaatctctacaccattagttaactctttttctttttagtcaataatatataccaattgaccttgtatattttttagcgtgatgtcattttctaaatctgatactggtattggcgacttgccgtttgatgatattagaaaggatttctcctcttcaatattaaattcgtagcggagtgattgataataacaaataactaacatatccacctacctacttttagttttagaagatgtacttgctgtagtacttgatgattcagatgactctttgttggaatttgtcgaatgattattgctatttttcgatttggattcctcatctgttaaggctgtcttacggtctttccaatatttatcatagtctgtttgtagctcagaaagtttttgttcacgatctttaccagataaactattgtcttttctaacctgatccattttctgaacaatagcataaataacaaggtcagaatcgtctaaacgtttggcagcatcaatagcatcatcatctaaaccacggccaatattaatccaataatcaagatagagctcatcagtcttgagcgtaacattgtttaaaataacttcacgctgttcttcagaaaatgacattccattaatataggaataggccaactcgtacttctgtgtataaggtaacttacttacttttacatgttctagtcgattaatcacttgattataatcaactttaataaatgaagtatccgctgccaacattttttctttgaatggattgtgaataaaaaccagatatactagcggaatcaagagtattgtagataaagctcctagccaaacacttatgtatttataaagcttatattttgcccttgatacttttgctaacgtatgagtttctacttctacttgctgctcataatcaatagtaatgatgtctctaacagcctgaatagtttctgcatgataaatgctttttaggaaatctgatacttcaataacagaaatagcaccattatacaactctatatagtcatgttgcgtcaataatgcaaagacaaaacatttgaattgatataaaaactcttctggaccaaatttctcaggtctcataatcccaggaaggctacgataagctattttagcagttgcattttttgttaaaaatagattagagggatgcaaaatgaaatttactgacaaagacaaagccttatctaaatccaagacattcaaggctaatcgtaatttttcagataaagtttcttttttaaagctttcaaaaaatagagcgtgcgcttctgtctggaattgaaattgaatggtatctgcatcaattgcagttgtcataggcatcaacaaagaatggtgaatttctaacaattgcagttgttgcagattttgagttcctacttttgaacgcttaagagataactgccaaaaatctggtcctttttcaaattgaaagtcttgttcttcaaatacaaacgaatctgtttccattaataaaactcctctatccttatacgatcaccagttgttactggatggtgagctaatatatcgttctctcccaataaaatacctttatttataactcttagttgatatttggtacgcctttcagtacggctaaaaatactatctaattccattactaattgcttaacgctaattttcaaagggatacgtaaatcttttgaggtttcccccatatctagagtaatgttaatatgtgtattcatcctttttgtcctttattttaaaagtcattatagaagctaatattagtaccaaactaatgagaaccaggtatataattatatgaccaatatcagccgaaacagtcggttcttctgttcttgtaacaaatttaaattgattactttcttcagaaaataattgtttgatacgttttttcctatcagattgtcctttatttgaatattgaaacagttgcttagactgctttttctggagtgagactttagattgacggtttttatccaattttttaaggtcttcttttttaaataaatctttagttaattcagtttgaaaaccagaatttttttgtgaatctgattctaaacgttttgtatcaaaatgaatatcattattctttaacccatcagaaaatactgatgtttgactcatacaggataatattagtagacaggctaaaaatcgtttcaacttcatcaacaacctcactcttttactttagcttcaaaatttaaggtgataaaaatattcatgataataaaagcaacatccacaagaagtactaagataaggaaaataaatccagttgtcacattatcaaaataagatgataattgattttcaaggatagatagtggattaatagcttttagtaattttggaagtccactaacagtcgctactgtgcctacggcatttgatagatacacaaaactaataatcataaacaaagctaaacccataccaactgctttaaaatttttaataaagaaatactgactatgaattaataaaaaactaaacagagtcataactaggaaccaagatggtacatattcaggcatgacatgaagacttctgcttgagataactcccagtgctaaaccaataacaagagagaggcctgaaatgacaatgacatttaaaaagtctgtttgaagccagcggttgacattatacctatctgtcaatttcttaataaggttttgagtcgcaaagatatatgctgtaaataggctaacaacttctaataatagtatccaagtgaatgggcgataagtattttcagttgccctaactgcagacgctgattcagcgacaggtcgtgataagaaattaaggagaatatcatttggcactccatttttataagcagtattaaaaactttagagaaagaagctacgaaatcaccattattggccaattctttttggaagttagccattaaatcggttgcatccgtcgaaagtttgttgcccgaatttttagcatcttgaacatctttattgaatgatgtgaatatttgattaacttggtccgcctcttgactattagatttggacatatcttttacgcccgctgcagaggtcattagcccatctagctggttcttcaaatcagataattgttgatcagttgttttctgtgagtcgtttactttagattgatcctgtgtgatgttttggaccttcatgttaattgattgaagggtttcaagctgttttttgattgcatctgttagtcgtacatttgtctcagttacttttgccatttgatccgccaattcatcttgactattttcaacttcctccatgacatctttaactttctgttgcgcatcagcagtgttttcatccatcaaatacttagttataccatttttgaccagatcaaccatcgtatcgttaacactttgatttaaaaattgatcaaataaattttgcggttcttcgccatcagaaataatgtagtatttagctactaatccgtgagtggtgttatatgcatcatttacttcttgtagagttcgttgatacgttgcctctgcctcaaagtaagaccgttggattttaccgtcatcattttgtacaatttgtttctgattcccgatagtgattgtatagcttggtttcgtaatactagagttagatgattccctttgataactgctattgataataatattattgttttggctggggtccaaggttcttgtttgcttaccattaaccgtccaggtatctaccctgtaatctggattatttgattcaacagaaactatctgctcaccagttcgagtagaactagatgacaattttaattgattaactttatttttagcttcatctctatttttcctagcttcaaaaagacgattcaataaattagtatttaaatacagagttctttcgttgcttacttttttaatgatttccgaatcagaagatgtaaactgaatggctttttcttcttcttgggttaagtgcaactccgaaaggtttagtgaaggaatgcttgaaatgagagaatttgtgaaatctgctaccttagctttaaaatctttcaaagtcttctcattagtagaatgactcttcaataattctaataaagtaatattatctttattattcttagcaaagtaacttgctagtccctctctaacaattttatctagttgttcactttgatctttagcaatgttatcttgtgacttgagtgcttcagatagttcttggattttttgccttgcaacatttagataagctgatgagttttctttatgattatgattgttatcatcacccataatactattgagttgtgatgataatgtttcttggtctttttgtgcttgtgtgataatatcagataattgcttctctaataactcgttattcatttctagtaatgaggtcgaaaacgcttcatacgaaatgctatcttgatggcgctgttctattaagcttgataaatcttttccagtatttgtctgggttgtcaccaaatcattaaacatgttatcagaagcttctaaagattttttcagtgattcgttagcagtaatggaactactagactggttaacgagggctggaaagatattttggaaattagttgcagaatctaaaagatttttttggtaatttgagatattacctgactgaacatttaccatggcctgtacattttcttgagctgtatataagttacttaaaatacttgccatgtacatatttactaagtggctatttaactctgaaacaatatctttctctttttcagttgcctttttctctaatgctaaattccccttggcattaaccttataagagatagttgtttgctctgcatttgctttattgacatcaagaagtttttgagaaaagttattagggatgataaccattaattgataatcacctttgtctaatccattttgagcagtacctcgactaacaactgaccaattttgactattatcacgttcgatagacttaatataactagctcctaaattataactttctttaccattagatacattttgatcttcgttgactaatgctatatttagtttagtgttagtagctgactgtgttgttttattctcttttgcatgatcgccttgaagcttaagattaaggccagcaatagctactaaaaagagagcaacagctataatataccaaagtattctaaagttatttcttttcataattcttcctaaaatatattttattttcaacaaaataggaaggctttgccttcctattcacttatagactatgatacgatactatccactaatttgagaagcaatatctgcatccgtctgctcaatgatatctgcaacttttaataattgctggttaatatcttcgagtaattgagcaaattctgtaatttttggagataattcattgaattgtgcttcaaaagaatcaaaagtagatccatcccaattttcgtcaataactgcttgctcttgagtaagcaaattaagaacttctgttacttgttgagaaccagctgtgtacttttgtgctgatgagcgaagttcttctggtgttaatttaatttgtgccataaattttctcctttttctataaacacttttgcaacaactgcataattattacaacatattttttaaaatatattcaaatttactgcattatttaaaattatttttaatgttattgtttaatcctgtttattttcatctatatcaacaatctgtccttgttgatttaatcgaaatcgtgtcaattcgtgaaagaaaatctttttataaaaaccatgttgcttcttagcattgactcttttagaaatacctaatttatcatctgaactattaataccaaaattaccaatgtaatctttattaatacggtaactatgatacttctctggatgtgaaattacataggatgtggctgcttcagacatattgttaatgggactaggggaattaaaaacacgcgctgataatctcatttctgaagccacaatcatggccaaataaccacctagagaatggcctgttaaccagagggttgcatcaggatagttcatcttaattttttgtgcaaatagtttagatgttgtaatttgacttggatttttacaaggcagagaaatgccatcctctctcagggtaatacttgaaggacaagttagcaatttattgttcttccccaatacaactgaatcgatatctgttaagatatctttcttattaaaagcgttcgttcctgaatatgctataacaatatgattactttcatccaaagactgacatgccatagcctgcataccattattgatatcatcattaacctctaataccataaaagagcgtttttgatggaaatcaataatttgactaccttctataatttgaaggtgtccattactttctgctttggatttttcaatattatatgccatatctgatagcactttaaaactactatctggaatcattcattttcctctctattcaaagaccaggtgatatctaactcatcaatagactgaataggttcctttttttctctaggtctgagatgaaaacttttaggatgacaaataatacctgaaatactattactgtcactaatatcatcaacaatgtaattgataatattaacgccatttattgttataatagaagaccatgaaccagtttctaaagaatgcctccactttgaaaaaacaagttgttgaatacctagatatctgtgtactaaatcaagggcgatttttgtttctaattcattaatatgtgttcgtgtttttaacataattaactccttaagtttgttccctattttatcacaattaggctttttttataaaaacagaacaagctatatttaatctagtccgattctgttttgctggaagttaattttaccttgatcgtttgattaatctagtacttttaatgtaaatgctctgctttcaagaactttgaacattgcatgtgcagtatctaaagatgtaaatagaggaactccttgttcaattgcagaacgtctgatgatgagagcatcatggttatcaatgttattttgtccaactgtgttgataactgcttgaatcttaccatttttaattaaatcaggaatatgatttcgatcgttctctcctaacttacctactaaaactgtctctaaaccattagcatcaaaataaattgcagtcccttgggtagcataaatacgataaccaatactttgatagacttttgcaagttctaaagcttcttctttatctgtatcatctactgtaaaaacaatgttaccatagtctggcatatggagatatgctgcttcaaaggctttatacaaggctttctgaagattaatatctgatcccatcacttcgcctgttgatttcatttcaggacctaataaactatctactttagcaagtttggtaaaactaaagacaggggctttaatgtggaccatatctgaagctggatagagatcataaccatatgtaaaattgcagagtttatctcctaagataacttttgttgctacttgggccataggaatgtgagttacttttgataagaatggaagtgttctactagcacgaggattaacttcaataacatatactttctgatccttgattacaaactgaatattcatcataccgatacagtttaatccaattgctaagcgttttgtataatctacaatagtttcgataatggtctcagacaatgtttgaggaggatatacagccatggaatctcctgaatgaacaccagatcgctctatatgttccattattccaggaatcagtatattctgaccatcggatatagcatcaacctcacactctttacctataaggtatgcatctataagcactggatgatctgggcttgcctttaccgcggttgtcatataatgacgtaaatcttcttcgttttcaactatcttcatagctcgtccaccaagaacatatgatggtctaaccaacacgggataaccaatcttttgcgctgcattaactgcctcttcctccgtagtggcggtaaaacctggtggttgagggatatttagagcttgtaaagtggcttcaaattgttttctattttcagcacgatccaaatcttctaattgtgtgcctagtattttaacccctgccttgtttaaatcttttgctagattaatagcagtctgaccaccgaattgtaagatgaccccttcaggtttttctaagtcaataacattcataacatcttcaaaagtcaaaggttcaaagtaaagcttatctgaaatagagaaatccgttgagaccgtctctggattagagttcatgataatcgcttcaaaaccagactctctgatggctttaacagaatgaaccgttgcataatcaaattcaactccctgtccaattcggattgggcccgatcctaaaaccaaaatagaggctttatctgatatcaatgactcgttttctacggcataagtcgaataaaagtagggcgttgctgaatcaaactcagacgcacatgtatcaaccatcttataaactggaagaattcctgcttcttttcgcatgttacgaacttgatcttcgtttatttgccataaactcgctatagctttatctgaaaaacctttatttttaacctttttgagaatattgatatccagtctgtttttagataatagatcttctaactctacaatcactcttaacttatcaaggaagaaagaatcaatgctagtcaaacttgctaatttttcaatactataatgtctacgtaaagcttctgctagataaaataagcgatcatcttctgcctttcttattttttctaataaaacatcatctgatacattatctaaatctgctattttaatgtgatcgacacctatttctagtgaacgacaagctttcaacaaagattcttctatattccgtcctattgccatgacttcgcctgtagctttcatctgtgttcccaattttctatcgccactttcaaatttatcaaaaggaaatctcggcatttttgcgactacgtaatctaaagcaggttcaaacatagcgtaagtcgtttttgtaataggattaattacctcatctagtgtcaaaccaacagctatcttagctgctaatttagcaattggatatccagtagcttttgaagctaaagcagaagatcttgatactcttggattaacttcaatgacatagtatttaaaactattcggatcaagggctagttgaacattgcatcctccttcaattttcaaagctcttataatatctaaactcgcatctcgtaataactgattttccacatcagataacgtttgtgcgggtgcaaaaactatagagtcccctgtatggataccaacaggatcaaaattctccatattacaaacaacaagagcgttatctgctgcatcacgcataacttcgtattcaatctctttaaagccagcaattgaacgttcaataaggcactgtgtcacaggcgataactttaaccccttcgtcgtgatgtcaaccaattgttcttgattatcgcacatgcctccacctgtacctcctaaagtaaaggcaggacgaacaattaatggatacccgatttgctctgcaaattgaatagcttcttctaccgaattaacaatctcagattctggaataggttgattgagttcttccatcaactgtttaaataaatcacgatcttcagctttatcaatggctgataatttggtccctaatagttcaacattcaattcttctaggataccattttttgatagagccatagccatattcaatccagtttgacctccaagagttggaaggagagcatcaggtctttccttcctgagaattcttgtgacaaactccaaggtaataggttcaatataaactttatcagcaatatctttatctgtcatgatagtagctggattcgaattgaccaaaacaacttggtatccctcctcttttaaagagagacaggcttgtgtaccagaatagtcaaactctgctgcttgtccaatcacaatcgggccagaaccgataaccataattttacgtatgtctgtgcgctttggcatatcaaactcctctaattctatattttaaagctagcttttttgctggaaatcatcaatcatattaataaattcatcaaaaagataagatgtatcatgcggccctggtgctgcatctgggtgaaactgcactgaaaaggcaggatagtatttatgtcgaacaccttcgacagttttatcattaatctcttcatgtgtaatgaagagagcctcagggaaatcttctctcgagacagcataaccatgattttgacttgtaaaatcaacctgtcctgtttgcaaatgacgaacagcatgattaaaacctcgatgaccaaaagtcattttataagtctttgcaccattagctttagcaaatagttgatgtcccatacaaataccaaaaattggaattttaccttgaatttcttggatcatttgtaaagcattcggtaattgttctgggttcccagggccgttagataagagtactccatctggattgagatttaagatttcttgcgctgtcgtagtatgaggaacgactgtaatatgacattgacgttgtgacagttctcttagaatagaatgttttaaaccaaagtcaactaatacaatatttttgccaactccaggcgaagcataagctaatttggttgatacttgttcaatttgatcatttaaaagaacacttttttgaaggttttctagtgcttcatgaatagaatttccctcgtttattaaacaagctttcattgttccatgttttcgaataatttttgttaatgctcgagtatctatacctgaaattccaggtattccttttaattttaaaaattcatcaagtgtcatctgttgacgccagttacttggatactctgcccattcataaataactactcccttacatgttggtctaatagattcgtaatcgtctcgatttatcccataatttccaataagaggataagtaaaagtaataatttgaccgttgtaagattgatctgttatagattcttgataccctgtcattcctgtactaaaaacgatttcaccacttgtttctacatccgctccgaaagcctcaccctcaaacacactaccatcttccagtaataatagacgcttcattttatctcctttattatctgctattgagcactgcttctaagatagctatccttgcatagacgccattactcatctgtttcactattcgagccttatctgcttctaccaaatcgctagcaatctctacatccctattgacgggtgctgggtgcataataattgctgtatcccttaaatgtttatagcgttcttttgtaagaccaaattgttgatgatagctttcttttgaaaacacccctttaccatcatgacgttcgtgttgaacacgtaaaagcataaggacatcaatttgatcaactaactgatctattggtaaatattgcccatattcatcgaattgactactataccattctttgggtccagaaaagaaaatttcagctcctaatcgttttagcacttgcatgttagatttagctacccgtgagtgagttaaatctcctacaatcgcaatttttagccctttgaagtatccaaattcttcgtaaatagttaccaaatccaaaagtgattggcttggatgttggcctgagccatcacccccattgacaatagctgaatgaatgttcggactagcaatcaattctttataatagtcaatatcaggatgcctaatgacacaaacgtccaatcctagagcactcattgttaagatagtgtcataaagggtttctcctttattaacagaacttgtatcagcattaaattcaattgtttttaatcctaatttgagttctgccatttcaaatgacttatgtgttcttgttgaattctcaaaaaagagatttgacacatagtaatctttatcaaaaccaatgttgctaggattttctttaacttcgatacttctctttatcaaagacataacttcttgatttgataattcttctaaactgacaaaatgttctaatgaaagtgtttgtgtttgatgattcatgataatttctttctataaattttagctagaaaaaagcctcctaaaacaaggaggctctgcaaaatagtaagctagatagggaactaacttactatttgttaacgcaattccttgtttgcctctctggacaataccttaaaggatattaataagaaatgttttacctataccaatgtcgctgcgtggctatctttttgatagactatttcaccattgcaaattgtgtagtgaataactcccttcaatttatcaccgataaaaggagagttgctggatttggaggcaaattctgcctttattattctctcttcagcttgatcaaaaataacgatatctgcaggtccaccttctctgagataacctgcatcaaatccatataactgtgcaggattacatgtcatttttgccaaaaagtcaatcattgagagttctttagtagatactaaataagtaatccctaaggctaatgatgtctctaagccagtcataccagagggcgcttgactaatattatctgctgctttctccataatatgatggggagcgtggtcacttgcaataattgaaataacaccacttttaagtccatcaatgagggcttgtctatccttttcaagtcgcagtggtgggtttaattttgcattagcacccttagttaaaagtaagttctctgtctttgaaaaatgttggggggttacttctgctgttaagttagcaccaagcttctgcgcaaaatcaactacttctactgattctgaacttgacaaatgctggatatggactttcgcctgtgtttggtaagcaatcatagcatctcgcgcaatcattgaatattcagcaagaccactagctccacagacatgataaattttctgagcaatatgttcgttgataccaaggacaccatttaacgatggatcttcttcatgtaacgataggacaacatcatgttttctagctaagttcatagcttcttgcaaaaccttagtatctgtcaaaggaataccatcgtctgagaatccagcaactccagcctctaatagttcttcgaaattaactaaatctttaccattcagagatttagtaattgtagcaactgtttcaatcttaattgcttcttttgctgcactctccttaacttgttttacaatttctgggctagaaatcgttgggttagtattggccatcataagaactgtcgtaaaaccacctactgcagctgatagggcccctgtatggatattttctttatgtgtctgtccaggctcacgaaaatgtacatgaatatcgactaatcctggagctacaattttattgcttgcatcaatgattggaatgcctttaatatcaatttctttcgatatttgtttaatttttccttgatcaatcagcatgtctgatacttgattaaaaccactttgagggtcgataatcaatccgtttttaatgatatacatatctgtcctctctaactttgccaattcatttgatcttctttaaattttttcagtaataccagttggtcagctgtaatatatccattaactttagcaactttaattaattgattgtaatccgtcaaagtcaccaaaggaatatcagcttcacgaaatgcttgttcagccttagctaattgatatgtaaatatcgctactacccctaaaacctcaataccttgactctgcgcagccgtaacagcctctaaaacagatcctcctgttgaaatcaaatcttcaatgataaccattttttggcctgagtaaacacgtccctcgatttgattccccacaccatgatcctttgccttcgatcgtatataggcaaagggcaagttcatcttatcagctataatagcgccatgtggtatgcctgcagtcgctgtccctgctatgatatcaacgtttgggaaatgtttctgtatttgtttaacaaaaccattttcaatcagtgtccttgtctcaggatacgataaggttacacgattatcagtgtaaattggcgatttgacccccgaagcccaagtaaagggttgttggggtcttaagtaaacagcttgaatatctaatagttccatggcaatctgtcttgctaaatccatctcagtactcctttatttaatacgattccattcttcttttatctctagatatgcttgatatggattttctgctttcgttataggtcttcccacaacgatataatcagccccaactatacgtgcttgctcaggagtcatcgttcttttttgatcatctaactgattggtttgtggaggtctgataccaggcgttaagcaaatgaaatgttcgttagtctgtttcttgatttgcattccctcttgagccgatgcgactactccatctaagcctgcttcttgagctttttgagcataatggcaaaccgaatcaactacacttaagttaatatgttgatccacctgcatttgttcttgtgaagtcgaggttaattgtgtcactgctaatagtattggacccttccccaaaccttctctagctgctttcatcatttcgactcctcctgcagcatgcacattagtcatatcaatgcctaatttggctaagacagacatagatgatcgaactgtattagggatatcatgtaattttaaatccaaaaaaatgcgatgtcctaaggatttaatatatctaataattgagggaccttcggaataataaagctccattcctattttgacaaaaagcaattcttcttttggaaaatgttctaaaaaagttgttacagaagccaaatcagaaaaatctaaggcaatgatagggcatttttctaacatataattcctctctatagaaataataattgttggaaatgtaccagtatgacacaaaaaaccttgcctgagggcaaggtttcataaaaagttagcgaaaaagcactcgctatttgacttatgatggtgaccttgttcgcctctctggactcacttaaagatacatttgtaggtattctacaagtttacaatcattttgtcaaataaatactaaattattttatcattttacgtctaataaagaacgatagaggaatctgctgtacaatactgattgctatagcaattgtaaaagctgttacaaaacaggatctaaaatattccattgctacggcatctgctcccgtcaataaaaagtaaacagctctatagaagctaagtcctggaataagaggaaacatacttgtcgctaaaaagacagtggcaggacacttacgtttagcagctaatagccgtgaaaaataagtgatgaaaagccctggaaaaaatacggctatagcatccatgtgaaattgttgccataagatcaggtagagcatccaagatattgctcctagtatacctaagtcaaggaaataacgttttggaacatggtagagaatagagaaggctatcgtccctaaaccggccattagtgttctgatgataatctcaaggatggtattaggaacaccagaaaaagaacctgtcatttgttctgcaaacggaataatttcaattgtaatagccacacctgctgatatagaaatacaaatgagtaaagcagacataatcaaagctaaacctgttgaaaaattattctgtgaaaattctctcaccgaattaacaaaggcagcccctggcaccataaccattagtgcccctaatataataatgctacgatgctcacctaatcctgaaaaatataataaattagcacttaaagccactacagaactacctagaatggtcaaaagaaatcctgtatgtatacgactttccatcaaattcagaaaatatcctaaaattaagcctgttacagcagcggaaaatgaatctaataaggaactacctaaggctaaagaaaaactacccgctccacaaaaataagaaattaaagtaacaagtaaactataatctttttgatgttcaattaagtctaactgctttacaatttcttctggagatactaagtcttgtttagcaatttgcctagaaaggttattaacagcttcaagtctacctaaatttgctgttacaccatctgtattgcatactttagcttcttgtttaccatagcggttaatcccggaagcgataatactgctactaaccacataagcttcaaaattttctatctgaagagccttagcaaaatgcttcattgtgtcttcgacacgatagacttctgctccgctttcaatcagtaatttacctgctctaagaacaacgctcatatcattttgcatcttatttggccctgccttctactttattaccttagccacttaactaagttggttaaagtcccaaacatcatccatccatccttcataaaagtccggttcatgacataccatcaagattgatcccttataagcttttaaagcacgttttaactcatctttagcatctacatctaaatgattggttggttcgtcaagtacaaggacattattttcgcgattcattaataagcaaaatctgacctttgattgctccccaccagataacacctgaatctgactttcaatatgctttgaagttaaaccacaacgagcaagagctgccctaacctctgcttggttcaaagcaggaaaagcatcccatactgcttcgagtggagtttggcgatttcctccgggtacttcttgttcaaaataacctaaatcaataaaatcacctcgttcaacattaccagaaataggggggataatacctagtaaactcttaagtaatgttgtttttcctatcccatttgctccaacaatagctattttttgattacgttcaaatgttaggtttagaggttttgttaaagcacgatcatatccaatttgaagatctttagcttggaaaataaaacgtcctggtgtgcgagattctttaaattcgaaacttggctttggtttctctgcttgtaactcaataatatccattttgtctagtttcttttgacgagacattgccatattacgtgttgcgacgcgtgctttattacgattaacaaaatcttgtaaatcagctatttccttttgttgacgttcataggctgcttctaattgagcctttttcattgcatagactgattcaaaattagtataatcaccggaatatcttactaaatcttgattttcaacatgatagacaatattgataacatcgttcaaaaatggaatatcgtgtgagattaaaacaaaagcattttcataattttgtaaatagcgttttaaccaatcaatgtgttcagcatcaaggtagtttgtaggctcatcaagcaggaggatgtctggcttttctaataacagttttgctaaaagaacctttgtcctttgaccaccagataattcagtaacatcagaatccataccaaaatccataactcctaatgcccgtgcaacttcatcaattttagcatcaagtgtataaaaatcacgtgattctaaacgatcttgtagttctccaacttcttccataaggctatctacatctgcgccatcatctgccatggatatatatatatcattgatacgtgcctctgttttaaaaagttcatcaaatgctgttcgcaaaacatcacgaactgtttgaccttcttctaatacagtatgttgatcaaggtaaccagcagttacatattttgaccattcaatttttccttcatcaggttgaagatgacctgtgacaattgacatgaatgttgattttccttcaccattagcaccaataagtcctatatgttcaccttttaaaaggcgaaaagaaacattctcaaaaatagcacgatcaccaaaaccgtgacttaagttttttacttctaaaatactcatttaaaatcctttgattgataatagaggttattaaaaaactcatagagacactctacaagtttttaaattagtacattacatagtaagttccatatacaagtatagagagtttaaacttaaaagtcaaaccttacttaattttttcaaagtgtaaatgaacagtgatttgatcatcatagccatttcgctctaaatcacgttgcaaacggtatgaaatatagtgttcagcagtatgaatgtatcctgcatccaataaacgattttcaaccaaagactgaatcatattgatcgttggtcgttcaacctgagcatcctctaaatctaagattacttttttagtcacttgagcaaggtcttgacgaagtgactcatcaagcacataaactgtttgagcagctttcaagatagcttggtagattttttcaggatcaaattcaacaatctgtccatcacgtttgatgatttgcataagagcccctccttaatgtggaaacaatgttaaaacgatttgcaatcattttcatttgttaatttcattatgcaaatgttttcataatttgtcaagtgttttacctgatattgacgaaaaatcaatatcactagcagtcagcataagtattaagcaatgtcatattcttctatattaattcaaattttaactcttttgctggtttaaccagcccattcttatgcaatgtttctgcaatttgaacagaattccaagctgcccccttcagtagattatctgaaactacccacatatgaacaccattttcttgatcaaggtcttttcgaatacgaccaacaaaggtctccctatggcctacagcattaatcgcttgagggtaaatttgctgagatggaaggtcttgtaggacggcaccaggaaaatttgcaatagcctttttaatttcagagattgaggctaattctttcgtctcaatataaatggactcagaatgccccgataaaacgggaatacggacgcaggtagctgaaaccttaatagtagcatcttccataattttctttgtctccaaagtcattttcatttcttcgtacgtataatcattatcagtaaaaatatcaatttgaggtaatgcattgaatgcgataggataatgtttttgatcgctagaacatggcaagactgttgcaattaattgatcaggtgaaaggttatcatttaaaacttgtctcaactgttccttagtttcttcaacagcacgtgcacctgaacccgaaacagcttgataggtggaaactataacacgctctatcccccatttttgacgaatgggctctaaagcaatcatcatttgaatagtagaacaattggggcaagctatgataccattatgaccaatcatggcatgagcatttacttcaggaacaactagtggaacatcaggattctgacgaaaatatgacgtgttatctactacaactgctccagactttactgcataaggagcgaactttgctgaaatagatccaccagctgaaaacaaggcaatatcaacatcgtaaaatgattcttttgttgtctcttcaacacgtatagcctcatctttaaaatgtaaaattttacctgctgagcgacttgatgataaaagtttcacttgttctattggtaaattcgattgttctaattgacgaatcatttgtgttcctacggcacctgtagcacctacgatagcaacggtatatcccatataatgacctctatttggttgatgttgttcatcaatattttcaaaacattttaatgtgactattatactacatttttataaactttcaagaatagccaaatgaaaaaagtcaccctaaccaacctaattataaaaaggaatctcgtatccgattcctttttattgattgcatatatcattatatatagttactaaatgattgattatacttaattttcattgcgtctcaaaccgcagcgacttgttaacaaaattaaaccaaaacctacaagtttaaaaatgacattttgatcatcacctgttttaggtaatttatttatcactgaaattgttctagaattattagttaacatcggtctattagctacattagtaacctgagatacttttttagagaatgactgtttgttagagtcaccttgactagagtgattattttctctagatataattgactttgaaagaagtggatttttccctataagttgacctacttggctcttgttctcaacatcgcgttgacgacgctctaaaacattgccctgactttgatttccaagttctaaaacctattttattgaacaattaattttctccttactttttttaaattttaaaagtcattttattattacttttatttagattatatattaaaacattttataagttatgtcaagataatttattatttagttgcaatttattattaatttgtatgtttaaaattaaatagttgatatctaaaacatgatatttttaaattttcctttaatattataaagcatgatagatagtcatactaacattaagatttacaatgaggtaatagtatatttttaatacttcatctaaaccatcagaaactagattatttaaaaattttacaaagaatgtgatggtagcatattcaattaaagttaagtaaagacataattttaagaaggaaattgtgacttatttatgcaaaaaagaaagaaccaaactggttctttcttttttgcttttcagctacttaccacaatttgtaagaaattacaagtagtagtaagctaagggcaccttttcaagtgtgacaagaaggttcacacaacttatcaagatccgctcctgcgtttataatctccctgcgcaatagtggtaaaaccacatatcgactcatcgcataacagtagtttaacataatttagttaaaatgcaacctttactttttaaatataactagattcttcagtttacttttaatattaaattaaaaataaattatttctaaagcaggggagcaatagtttttgtcactatgccaattactttttggaattttggaatattatttatatctttcaagctaactaaccttgatttatttaatgtatccatataatctcgataaatgtcttggattgcatctaccttataaagataaacagcacattcaaaatggtgatacaggctacggtaatcaagatttatcgtacctacaacagcctttgtattatcactaaggaatatttttgaatgaacaaatccaagggtgtattcatatattttaacacctgattttgttaaagcttgatagtaagttttagcaagagcataagggattggcttatctgggatacccggcataataatacgtacatctacaccacgttccgcagcaaactgaatggcatgttccaattcactgtctaatattaaataaggtgtcatgatgtaaacatattctctagcatgattaagaatatctatataaacattttcccctactttatcagtgtctaaaggagaatctccataaggaataacatagccttcattttcaactaaatcatcgtgtacaccgaggtaaggcgctactaacattttttcctcagtaatggaccacatctgtaagaaaagtaggaggaaactatccactgctttcccctttaacataatacctgaatctttccaatgcccaaataactcaatgtgattaatatactcatcggctaagtttacaccaccagtcatgcctactactccatcaataacaacaatttttcgatggtcacgatagttataataagttgaaataaaaggagaaatcggagaaaatgcttttgcttttattcctattttctcaagtcgtttcgtataatcaaaggataattttgtaatttctatcataccatcatataagatacggacttcaacaccttcttccaccttttgttctaaaatactaagtatttctccccacattattccttcgtcaatgataaagaattctaaaaagatatactttttagcttttagtagttcttctttcattttttcaaagaatgcttctcccgttggtagaaatgtcacatcagtatttcgataaactgggaaatttccatgtgctttttcaaaatattgaaccaaatgatatgttgtggatgtacttgacttaagctgattcaaagtttcaggatcatcctctagataaatctgactctcatcaatcaatgtctccaatctttgtttcaaaccacgataaccccagtcaaatttggtgtacattaggaacatcgcccctagtaaaggggcaatcattaccaatattaaccaagttactcgggacaaagcatccatttcactattaactaaatataagaccgctccaattgttaagatatgctcaacggttgctaaccaaacacgatactgctctagccatgagtaagaggctagtaaaaacaataattgtaaaatcaataaaatagcgataacggttgttcgactaaatataccccttagtaaacttttcttactcttattaagtaaacgaacaattttgactttattactgataagtttttcccccctccaaatcaatcattttattatagcatactgtcacttgaatagcattctattattctaaattatctctagttaaaatctaatccccaataaaaagaggctagcatcacaagccctacctctttattatttaaaataatccaatggctgtaccgtcttctaaaacatccatattgagagctgcaggttttttaggtaaaccaggcattgtcaatacgtctccagtaagagcaactataaaaccagctcctgtttttggaacaaattcacgaacagttatatcaaagtcagttggagcaccaagtaaatttggattatcagaaaagctatattgtgtctttgccatacaaataggcatcttgtcccagccattgtcactaaactcttttaattgtatttgtgccttaggtccaaaatgaactttattaccaccatatattttagtaacaatttttttaattttttcttcaatagtgtcttcatcattatataagcgtttgtaattggatgattgtgtttcaatcacattagcaacagtctgtgcaagttcaagaccaccgtctgctccatcttcccacacacttgctaattcaactgccacatcaatattactacataaggttttaagagttgcaatttcactttctgtatctgcagtaaactgattgatagctacaactaccggaacaccatattgacgcatattgttaacgtgacgctcgagatttgtaaaacctcttttaactgcttcgacgttctcttgtgagagatcttcttttgaaacacctccatgcattttcaatgcacgcaatgtagcaacaataacaatcgcatcgggagaagtcggaaggtttggcgtttttatatcaagaaacttttcagcgcccaagtctgctccaaaacccgcttcagtaacaacgtaatctgctaagcgtagagctgttgaagtcgctaagacagaattacatccatgtgcaatattagcaaatggtcccccatggacaagagccggtgtcccataaatggtttgaaccaaattaggtttgatagtatcttttaggataagtgtgagagctccttcaatcttcaaatctttaacatagattggtttacggttccttgagtaagccacaacaatatttgacaggcgtttctttaaatctgataggtcagtagctaaacatagaatagccattatttcagaagcaacagtaatatcaaagccatcttcacgtggtatcccattgacagggcttcctaagccaacgatcacctgacgaagagcacgatcattaagatcaactacacgcttccaaatcactcgacgttggtcaatatctaattcattgccttgatgaatatgattatcaagtagagctgataaagcattattagcagttgtgattgcgtgcatatcaccagtaaaatgcaaattaatatcttccattggtagtacttgtgcgtatccacctccagcagctcctcctttaatacccattacaggacctaaagaaggttcgcgaagagcaatcatcgtttttttaccaattttatttaaagcatcagctaatccaatgctcatagtggattttccctcacctgctggtgtcggattaatagcagttactaaaattaactttcctactttttgagattttacagcttcaatcttatcaaaagataattttgctttgtatttaccatacaattctatatcatcaaaaccaattcctacttgctcaacaatctcagcaataggctttagggcgacgctttgcgctatttcaatatctgttttcatgatattctccttctaaataataaaaatagtatagcaatattccctataaaaacatatttttttgcaaaaaaaatttaaaatgttcgttttatgaaaataaaactgcttttatttcttctggactagtctgaccaaaataatcttctaatgataaagtacttaatttttccaagactaattcttctttcataggacaaccaatgagaaggttttcaatatctgaaatatctttagaactgaaaaagtcaccataaatacggcaattcgtaataatacctttctcaatttctaagtgaaaatcgtaagttcctgacggaaaacgagcatctctgtgatacgaatactgtggtgagttaccataattccaatcccaattcttatatttttcatcagctagagcgtcaatcgcagcccaatctttttcggttagatgatagcgttttgcctgatcaatatgatcaatatgtaataattgacaaaccattaaatctttaaattgatcggttgtgatatgacgataatcttctgacaagtggctacgaatatctcctactcgacttcggacagattttatccctttagattcaatttttttccgattaggatttaacactttttccatagcatcaaaatcaacatctaataaaagagagtaaccaccgtaaatacgaccgtttactatcgtcattgctgcacctgatacttttttaccatcaataactaagtcatttcgttccctcatttcaacactagaggcacctaaagtttttagggccttaatagctggctcataagctcgtttgaaatcaccaaattgtccatgatctttcatgagatagcaaatatttacagcacctgagtcaacgtaaacagcccctccaccagtatctcgacgaacaacaggaatatcatgttctttcaaatattcttgatttgtctctataactgcattctgaaattttccgatttcaactttgggatcacaatagtatggaaataaaatatcatcatctaaaaaaacattttgtaaaatataaacttgcatggcaagtgcaatcgcaccgtctgtgatacgcttaccatttctaattggttcaataagatacatttaggtctccttttatagcaatttagttatccaataatttcttttttcgcttcagcaattaattcagcgatatgctgtgtcagttgcacactccttgagcgaatcttttgaggaatgcgataatgcttgtgattaagagtaacaaataaagagttttcatttaaagagacgaatcgccaaaacggatgcttaataaattgtggcgtggtatgtccaactccaatctctagataaagaactttgtcattttgatgttgtgataagaaattttcataacgttgtcgttgagcatgaaagtcagcatcttccaccatacctttttcttcgttacgtttattaatttcaaacggttgatcacactttgggcatttggggattaagttactaggaatcttcatatccttttgttgtgcaatcatttgacgaattgcctgatcatttcgataagtttgttgatgacaatgttgactacactgccataagccatattcaccttgaatatgaaaaactttttctaaattataatcagccacagcgaaggcattatcagcattagttgtaataatatgatattcttttttcgctaaaatatcctttaaatcaagataagcttgtcctaccggttgatctaaataattaagtgccacaaaacgactttggaaggcccaatattcttcccaatcttcaaagtcataaagacttgcttgcaacatatctaatagttgatatttagcaataaaatccggaaaagcttcttcaaatctggggccaatataggtgaatccatccgctgcagacatgcctgcaccaataccaactacaatagcatctgattcttctattaactgacttagtatttctgattgagaatgattagttttttctagagtcttccacactgtcatctatttcctcttttaataataatttttgataaatatcttggtctttaggtgtgaatgtattgaaaataatatagagtttgtgctgattttcgcgttgccactctaatatcgcttgaactgccaattcagcggctctttgattaggaaaaccaaattctcccgttgatatacaagggaagacaattgttttaagattagctcgaactgccaattgtaagcaagatttataagaagactttaataaatcctctcttatacgagatggcttttgatcaacttttacataaggtccgactgtatgaataacatacttacaaggaagatgataggattcggtaagtttagcttgtcctacagcttccattcgtccttgttgtgtcatcaattgatgacatgctaaacgtaatcgtgaacctgcaaacgtatgaatctgattgtcaatacaatggtggttaggaataaaacaacctaacaatttactatttgctgcattaacaatagcatccacttgtaataagcaaatatccccatggtaggtaaatacatttgaatataccgtttgatgacagacgtctatcgtttttactttttgagtattccaccaatgtgacaaatacctatcttctaaagacaggtactcttgactaatgttttgaggatcttgttgattaactagaccacgccaaaccgtttgcaaatcggtggtcctcaagtcatcaacgtctgttaatttttctgactgaagatactcaatcatggctagcaatagttgtttttgattaggcattttctaaagcttcaaaagcagcataatcaacttctgttaacacaaccaaccaattttcgtcagctttttcagaatttaacaaagttggttcttgacttgcagctgtattaactttaacaactttacctgtaagaggagataaaattgccataaccgtctttgaagcttcaatatttaaaataacatcatcaacttctaaatttgcatcatctgtgaattccacatatccaacagttcccaagtcatcttgaagttcgggagttaagctgatagtataaagttcttcatttttttcaattaataagtagttcgcaatttttttcatgagtattttcctttctgagaaaacgtgattaatataactgtgataataattttaaggatttgattcgttggtcaagtcctggaacaagaggaatcaaaagtagttcttctgcttgactagcattaactaaagcgtcaagactttctttaacttgttttggatcacctacaatcatacggtcgcgatttgatttaatttttgctttttgttcaggagtcaattggtaatgattagcttcttcaatagtaggaaatgttgcaaattcattgaagtctttatttcctagcatccagatatctaaagtctttgctatgttttcagcttcttctgaagtatcagctataactacaaatgcagctaccatcaaattaggagacttattaggataatattcttcaaactgatgataataaagagatgaaagctttttagcttctgtcaatgggtctttgtccataaaaggaaaaacaccgaaggtaaagcctaagccaagtttagccgctaaataagctgatttttgaccactccccaacacatataagtctgggaagctagaaagagtcggttgaactaatggttccttactggatgattcatcaataagccatgacttcaattcctccagtacctcttcgtaatcatgtgctttatgtaagctacgaagtgcatttgaaactttaactgtccctagtgaatttcctaaaccaatacttactcgattcggatgacatgtctctaatgtcttgagagtctccgcgagtttaaaactactatagtgcagaggcattatacctccagagccaattttgatagatttagtctggttagccaaatgcattatcattaattctggattgctaatactgaatgccttaacaccgtgatgttcagccacccaaaattgatgatagcctagtcgctccgcctcttgtgataaaagaatcgtttcttgtattgcatcacttgcagtttttccataatcaataagcccataatcaaggacacttaatttcatctttcctccctataattgcttcgaagttctctaaaaacttctcgagcttcctttggtaaagattctccataatccatcaaaggaacaatatctttaaaggaggcttttggaatcgccaaaccttctaaatcactcactttaatccttaaattaatctgatcagaacacttagcttttattttttgtaaaaattccggatcaactactaagggcgtggaagctcctatcatatgagcatgttgtaaggcttcaaacacctttgaagcactattaatacctccagttgccataattggaactctatcaccaaaatgttcaaatataacttgattaaccagctgccctttgtaaactccctcagaacgtatagtatttctaaagacatcatgcccccagcttgcaatggcaagataatctacctgagcaatcgctaaaattttttcaagaaattccataaactcttcaatgctatatccaatttgtgaaccgcgagtttcttcaggcgtcgctctaaaaccaaggataaaatctgactccgcttcttctctgataactttttgtaccgctttaaaaacttctaagcctaaacgacagcgattagtcaaagtttgaggaccatattcatcttttctttgatttgagaaggttgagaaaaaagtttgaattagtaatcgttgtgcagaagatatttcaacaccatcaaatccagcttgtatagctcgtcttgtagcctggacatattcatcaataatccttagtatatctttgtgtgttagttctttaacctgatgtgggtatggcgattgcaattgcatagggctgggaccatatacatatccgtgtcttgccaaagtgtgacttgagaaacgtccagcatgcgtcagctgcaaaacagctttcgctcccttagacttcattgctttagccaatttagtcaaaccaggaatgtcctcatcctttgaaacgctaaaaccatattcaaataactgaccatattctgtgatatatgctgctccagtaatttgtaatggagcggatttagcacgacgaacagcatatgctatgtcgtcatcagttacaaaaccttctgatgtagaagaattagttaccataggtgatagaacaaaacgattttctaagctcaatccattgggaagtgttaatggacgaaataaattaccttggacattattcatctctgctcaccatccccttattagccatagacttagcctgaaatctattaaactctgcaactaaatcgggtctaatcatcagtaaacgatcattaaaacctacttgtttaaggctaatcaacatacgatcaataacatcttctactgtcataggacaatctaatagatcagatagattagccataatttcaggatctacatttggataagcaattggactacccgtatcacctagaccaatcttataaaaatctgaaatcatttgactccgccctttttgatcgccacaaacgctaaggtaaattgataccgcaataccattctttatacggcgctgagccaagccagcaaattttttgccatttatactaagatcaaacttaccaggacaataggaggtctctacttcaaagtgctcaataggttgataaaaatctgaaaatatacttctaataaaatcgaccattataagatacccatctgagatagacaattttctctcaaaaacatctggaataaccaatgaaaaatttaaaattccttcatcagctacaactgcgagaccaccaaaattccgaacaactggttcatagccacgactgatgatttcttttttagctaattctaaatgtggtaattctcgatctaacatccccagaatgactgtcttagtcatcggccaaatatgcaaaataatttcttgatttgagcgattaatctcccttaaaaatacttctgtccatataaaaggtttttccgcgtcttgagcatctgtaacatagtctttaaaaatagatacaggtaactgcgctagatcttgccattccaataaatctgacatcctttctctagaaaactctgcaagatttattttatcgcaatcgcttgaaattttccagtaagtttccctcaaattccattactatcaagaagaaatatatcttttatttacgaaaagcatttttttatgtacaatatggctatgaaaattttgattacatcaggtggaactaccgagaaaattgataccgttaggagtatcacgaatcacgcaacaggaactttaggaaaaataattgcagaaaaatatttacgagaaggacatcaggtgacactcgtgactactaaaaatgcagtcaaaccagaatctgctaccaacttatccacatttgagattgaggacgttgactcattaataaaaaccttgaagccattagtgaaagagcatgatattttaattcatagcatggcagtgtctgactatacccccgtctacatggctgatttcgaaaaggttaaatcaagcgatcatttagatacttttttgcgcaaagataaccacgaagggaaaatatcatctgaatcagaatatcaagtcctttttctcaaaaaaacaccaaaagttatcagccttgtgaaaaaatggaatcctcaaattactctagtaggttttaaactacttgtgaacgttactaaagaaaatctttttaaagttgctcgtcatagcttaatcaaaaataaagctacgtttattttagctaatgacctcattgatattacctcaaaacatcacatagcctacctacttgaccatgataatgtgtataaagctaccaccaaagaagatattgctcaattaatttacgaaaaggtaaaaaaatatgattaaacgtattacactagccgtcaccggttcaatttcggcctataaagcagcagaccttacaagtcaattaactaaaattggctatgatgttcatatcataatgacacaagctgccacagaatttattacaccgttaactctgcaagtattatcaaaaaatcctattcatttagatgttatggatgagcataacccaaaaatcatcaaccatatcgaattagcaaaacgcacagatttatttatcgttgcacctgcctctgctaatactattgctcatctagcatatggcttcgctgataacatcgtaacaagcgttgctcttgctatgcccgatgaaactccaaaacttatcgcaccagcaatgaatacaaagatgtatcataatacaatcacccaacgtaacattgatattttgaaaaaaataggttatcaggaaattgaacctcgtattagtttgcttgcctgtggtgataccggtcaaggagccctggctgatatctctactatacttaaatgtatacaagaagttgcaaattaggctgtaaatttgtatactatttctagtttaatttaaggagttataatgaaaaagaaaaacaaatcctctaacattgctataattgcaatcttttttgctattatgcttgtcattcattttttgtcatcatttatttttagtttttggttagtccctattaaacctactttgatgcatatcccagttattattgcatctatagcctatggacctcgtattggtgcaactctaggcgccttaatgggggggatcagcgtagctaacagcagcattgttctattaccaacgagttacctcttctcaccttttgttgaaaatggtaatttttattcgctaattattgcacttgtaccacgtattctaatcgggattattccttatttcgtttacaaattactacacaaccgctttggtttggctatctcaggtgctataggctctctaacaaacacagtatttgttttatctggaatttttatctttttttcaagtacttataatgggaatatcaagctaatgctcgctgggattatttcatctaattcattagctgagatggtcattgcagctatcattgtatatctaactgttcctcgtattctcaatattaaacattaaaaactggccaggaagaaatcttcctggcttttcttacttatattttatagtcatattgaaaaaaacatgttataatgaaagcgtttataaatattgaaggagtatttcaatgacttacacagaaaatcttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattggcaaaattaatcgaaactaagggagaggaagctaaaaaacgtggtgtagccattgcctatgattcacgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcatcgggccttattcaggttatcggtgaagatgttgatattgaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgtcaaatctcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttacggcgctacaatgtttaacgttttaactggatttaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggttattttgctgaaaaaacgatttcagtaacactttcaggtgtggatggagctgctgaaattaagaagattatggacaaattccgtgaaaatggtccaaaacaatttaacaatactgacattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacggtcggtaatgatttagcagatgcagaaacaaaaatcgccaatattgaaaaagagattacaacatttgtaaattaataaaaaaagctaggaactgaactgcaccccaaaagttagacaaaaaatctaacgattggggtgcttttctgatgaaattaagttatgaagataaactagaaatatacgagttaagaaagatcgggatgtcctggtctcagattagtcaacgatatgatgttcgtatctcgaatcttaaatacatgataaaactcatggatcggtatggtgtagaaatcgtcgaaaaaggtagaaatgagtattatccacctgaattaaagcaggaaatgatagataaagtcttgattcatggttgttctcaactctctgtttctcttgattatgctctctctaattgttctatactcacaaattggctttcccaatttaagaaaaatggttatactattgttgagaaaacaagagggagaccgagtaaaatgggacgtaagcgtaagaaaacttgggaagaaatgacagagctcgagcgacttcaggaagaaaatgagcgcttgagaacggagaatgcctttctaaaaaagttgagggatttgcgcttgagggacgaagccttacagagcgaacggcagaaacaattagagaaatggtcacaggaggattccgactagacctcttacttgagataactaagatagctcgtgcaacttactattatcaactaaagaaactgaataaaccagataaagacaaagcaatcaaatctgacattcaatccatttatgatgaacatagaggaaactatggctatcgtcggatttatttagaactgcgaaatcgtggctttgtcatcaaccacaaaagggtgcaaggcttgatgaaaagtatgggcttgactgctcgtattcgtcgtaagcgcaagtatgcctcttacaaaggtgaggttggtaagaaggctgataacctgattcaacgccagtttgaggggtcgaagccctatgagaagtgctataccgatgtgacggagtttgctttacctgaagggaaactttatctatcgcctgttcttgatggctataacagtgagataattgattttaccctgtctcggtctcctgacttgaaacaggttcaaaccatgcttgagagggcttttcctgcggcttcatacagcgaaactattctccacagcgaccaaggctggcagtaccagcacaagtcctaccatcaatttctggaggacaaaggcattcgtccttctatgtcacggaaggggaacagtcctgacaacggtatgatggaatctttctttgggattctaaagtctgagatgttctatggcttggagaagtcttataaatcacttgatgaccttgagcaagctatcacagattacattttttactacaacaacaagcgaatcaaagcaaaactaaaaggacttagtcctgtgcaatacagaactaaatccttcacttaaaataaattgtccaacttttgggggtcagtacaaacttactcctagctttttttatatctatctaacgatattctattattttcaatcatgaaatataactgcaattaacttcacgatcaaataatagagcagacttacaattaaccacgttatcccaataactgcaactaaacctattaaaacagataataccgtattcttagttgctagttggttactgataaaccatgaaactgcagaaataaatatcagtaataatagttgaagcctttttttcatataattcctcttactacttttgtgcattttgcatttgataataaatacctttttgagccattaattcagagtggttacccacttctacaatttcaccagataccataactaaaataatatctgccgtttgaatggtagataagcgatgtgcaataataaagcttgttctccccttcatcaacatttggaatgcttcttgaacaagaacttcagtacgagtatctatagacgatgtcgcctcatctaatatcaatattctaggtaatttaagaaaaatacgagcaattgtcaatagctgacattgcccctgtgataacgaatctccagcatcttctaaatacgtatcatatccattcggtaattgtttgataaagaaatctgcattagctgcttttgcagcctctatcacttcttcacggctagctttaggattggcatatgcaatgttatcgtgaatcgtagcactttttaaccacgtttcttgtaataccattccaatttcttgccttaattgtgatggctcataatcagtaataggcttacaatctaaaaggatatttcccccgtcaacttcatagaaacgcattattaaattgattaaagtagacttcccagcacctgttggtcctacaatagcgaccttagctcctgctggaatgtgtaaattaataccattcaatagtagttttgatttattataaccaaaaacaacgtttttaaaatcgatttgacctttgaccgttgatgaatcaagtttttctgtacctgttatatttggtgacgattcttctaaaatagagtaaaggcgttctgcacacgccagagcactttgcatctcagacaggacggaagagatgtcattaaatggcttagtatattgattgacataatttaagaaagtgattaattgaccaacactaaaagcccctgacataatgcgaagggcaccaatcccagctaagaagccataaatcaaactattgataaatcgggttgatggattgacagttgaagaataaaaaattgctgattgagaaaagttagcatactcttgattaatagtcctaaaatgatcactactttcttcttgcgcactgaatgcttgaataaggctttcttgactcaccatctcttcaatgaattgagtttgtcgtcctcgtgatgccgtttgattttgatataagtgataactctttttagcaataaagcgggctagaaagagtgataaaggcgtcagaaataataccaaaaaaagcattaataaatcaatctttgccatactaaaaatagtaactataatagttaataaaccaacaaagaactggttaaaaaccattaataaaccatttgataattgctccgtatcggtagtcacacgactaatcaagtcacctatgccacgtttatcaaggtaagctataggcaatagattcaacttttccattacagcctttcttaaagaagcaacataatgaaaaattaagcggttatagagcagaggattaatccattgaataatagtatttgctaaaatgactgcaatcatcttccacattataggtaacaataatatcatagaatgaggcgataatacaacgtctaccgcttgtccaattagaacaggcaaataaacagtgaggcaaacttgtacaaccgtccctaataatgccattcctactaagctttttttagaaagaagatcttgaacaagctttttttgtatctttttaggatgacttgctttcatttactcctcctccttaaaattttgtgaatggtaaatggacttataaactttgttatgagctaataaagattgatgattatcaaaaccaacttgtttgcccttatcaaggagtaagattctatctgcattttgtatactattaattctctgtgatacaataataagattagtttggttgaaatgtttagttatagctttaaataaacgagcttctgttaaataatccaatgcagatgttgcatcgtctaaaatcaaaaatggtatcttatcttgaactaaagctcttgcaatcgtcaacctttgcctttgaccaccagagaaattcctaccaaaactctctacaggggcgtcaagttgaccatctttttcttttacaaaatcactagcttgtgctatttctaaagcagtccaaagtttttcctcactaactttaccaagtcccaaagaaaggttagaacgaatagttcctttaaacaactgagcattttgaggaacaactcttaccagggtacgccaatttgaaattgtatctggactttttccctgatgatatatatcaatatccccttcttgcactttataaatatgaagcaataaattaatcaaggttgatttcccagagccagtcccaccaattatccctaaagtttctcctacattcatagaaaaagtaatatcagataaagctttttcagaggagtttggataagaaaatgccatttcttgcacttctaaagccttattcgaatattttggctcaagtttgtcatcaattatttcagacggtctttcaaaaacggctataattcgcttagcactgatataactttggttcagtgatgtcaccaacattgtcatttttaacaattcaacaagaatttgcaataagtaattaattaaagcaaccaacattccttgtgataaaagatgattagctatatttaaattaccacgccaaataatcacaaccaaagtgatattaacaactagaaatgttagaggcgttactaaactagaaagcctacctgcttttaattgtaaattcgtataatgataattgatatcattaaatgcttcactctctctatctacttgattaaaggcacggataactcgtacaccttgaagttgttgcctagtcaactttaccaaataatcggttgaagttctgattttaaggtaaataggatttaatagtcgagacattacaaaaacaatgataaataacgtgacaaccattaccaagaaccaaatagtcaatgaggggctaatggaaaaagccataattatggcaccaaaaacaataatcggagccctcaaaaataaacgtaaaaattgatttaaaccagtttggatttgaaatgtatcagcagtcaaacgagtaatcaaactagcagttcccaattcatctctgtcttttttacccagtgacatgactttttggtagagatcctctgtcaattgtctcgtataaccaactgcggcttttgaagaataatattgagcagttatcgctactacaacacccaccgcagccaaaaagaaaatcaatccaatttgcaacagtaaaccacttctatcccctcgtggaatggtctcgtcaatcatttttgcaataacgattggtaccaaaagttcaaaagaggcttctaataatttgaaaaggggtccaaagatagtttctttgatataccccttaaaataataagttagtcttttcatacttacccttcttaaaacaactccattatttttatcaaataaaggttgaattgaacttcacgtgagtagtaaatattaccaccatttttatagagcttccctcctgaaattaaggcgagaggatgatagtaaaagtaagtgtccccgttataatttcctaggctgggagctacaacatttttagagtaatttttggccaactcaatggaattttcacccccatgatccgctacataatcaatataagaagaaccaaaattgtatgcttggacagcagtccatacatcaaccttagcttttttagcttgacttatattttgtgacaacagagtgacgccatgtttaatactggtgtggctatccgtaatactgttcgtagttccactgatactttcacttgattgcatcacatctatagcatctcccttagtttcagtataaatcatagataatactaagtgcacattagcctctgaaccattctctgcaagagtattctgcactaaatcatgatattgaagcacttttttaacattttcatggatgataactagacggtacccaatgaaaataataataattaatgctatcaaacgttttaaaaatttaaacatattatttattttgaatatcctgtatgtttttgattagtattgagtatgtaccatcagggttttggataaattcaactgattcggcatcttggtagacattgttgggtacaatcaattcaataccatttgaaagagatagcttctgattctctaacttcttaatttgacgggaatgatcaatatcacttacttgaacaggtccaggtattgcgtctttcaattcatcaacaaaagtcagcctggctgttaaattatcatcaaataattgatctgctaatttttctggagacaattcttgctcttcttctaaattcttataaatagccgatttcatttttgattggaaagaaaaatcatctttgttgaaattttcagcaattttttgagctgtctgttcaaccatttttatagattttttaacagactgttctggttgtacttgtaataaattttcagaaaaataattagcaaatgaaccattgtgtttgatacgcttttcaattaaatagtattgctttgatgacttgttaacaaccaaagcttcatctggagtttgagcagcacttggaaggttattctgtgttattgtaattggctgctcttgattttcagaaacatgagcaaattgttcctttaatgagattcgaaggaaagcaaaatgttccattccatccttgtcaaattgaataaaaactaagtcattcgttttttgatcttccgatatgacaaactcttctttccaaagttgcgcaatttgacaggaagaaacatataaatcatcttgtaaatgactcataaatacattatcctctccaaaatagccacgcttagcttcatcagaaaaaactttacttaattttttacgaaagtagtcatcaatccttggagttagggttagcggagtatctgatagcactaactctgtgtcgttaggagaaaactgatgtataataatctgtttgatataaaaatccatcataacattaattctcatacaaagggaaagcgtccgttaatgatttaatttcttgacgaacttctgtgaggacatcttgattttcatgatttttgagtgccttaatcattaattcagcgattcttcgagattcttcaactcccattcctcgactagtaattgctggagtaccaattcgaatacctgatgttttaaatggtgatagtcgctcaaacggtatagagttcttgttaagggtgatattgacttcttcaagaacattttgtgcctttttgccattctcaataacttttgtgacgtctactaagaacaaatgattatcagtaccatcagaaatcaaatgaaagtcatcatcttctttaaaaactttagccatggcttgagcatttttaataatatcctcaccgtatattttaaaggaaggatctagggcttctttcaaagctacagcttttgcagcaattacatgttctaatggtccaccttggagtcctggaaagactgcagaattaatttttttagcaattgcttcatcattggttaaaatcaaaccacctctaggtccacgtagagtcttatgtgttgtcgttgtcgttacatgagcataaggaataggactagggtgatgaccagaagcaactaaacctgcaatgtgagccatatcaaccattaagtaagcatctactgcgtctgctatttgacgaaatttttcaaaatcaataatgcgagaataagccgacgcccctgcaacaattaatttaggctgcgtttcctgtgctattttcaaaatgttatcatagtctagcatctccgtcttaggatcaacagagtaagaaacaaaatgataagtttttcctgagaagctaactgaagcgccatgtgttaagtgcccacctgctgctaagtccatccctaagacagtatctcccggctcgattaaagccatgtaagctgctgcattagcctgactaccagaatgtggttgaacattagcaaactcagcattaaataacgtcttagctcgttctatagctaaactttcaactacatcaacacaatctgttcctccataataacgatgactaggatacccttcggcatatttatttgtcaaaacagaaccttgtgctgccataacagcttttgaaacaacgttttctgatgcaattaattcaatattattttgttggcgaatttcctcatcatgaatagcctgccaaagttcttggtcaaattctttaaaattgtctttatcaaaaatcattttttactccttaagctcgttataacttttaaataatggtttcaatcattatatttatcacatttttactattagttgcaagatgattaaattaattttcaaaaattaattcaggtatcgtagccgttagtacctcttgcgtgattgcaccttgccttaaaatcttaactctatcaccagacaaatcaataatagtagaatccacacctgtcaatgctttatcatcttcaatacctaaaacttgatgattaaactgtttttgaatttctgagaacacacgaccactatcacatccagaaatattagcagaaggaccaatcagtggaccatggttagcaatcatatcaagggttacagggtgtttaggcatccgaaatcctacgcttaataacccagaattgatccaatgcggaacttcttgtgaagcttccaaaataatggttagcggtcctggtaaaaaagcatcgtacaattgctttaaataggtcggttgatttttagaatattttaaaatagtctcaaaatcacatatatttaagttcatagccttatcacgaggcctttttttaagctcatagacgtggttcacagcttcttcactcaaagctttggcaaaaattccgtagactgtttctgttggcataataactgcgccatgatcctctaaaatctgtcccaaatcattcattatctaataccaccattctatctttaccaaatatatctttcaaaactctgcaacgattgtttggaaaatatcttttcaataaacttcgtaaatcatcaccttgtttgtaacctatttcaaaatataatttacctctaggttgcaaatattctcttgagttttcaatgattttacgataaatagctaatccttcttcgtctgcaaaaagggcactatgaggctctgaagctagcacattcttccccacctcgtctttgtcattgtaagaaatatagggaggattagacacaataatatcaaatttacctgaaatgttactaaagacatctgattctataaaagtcacttccgcatcacaattattagcattttcctttgccaagtctaatgcagatacagaaatgtcactagctagaacatcccaagaggggcgttctttttttagagaaatggcaattgctccactacctgtaccaatatctaaaacagaacaatcttctactttattctctgataagattagatcaaccaactcctctgtttcaggcctcggaattaaaactcgttcatcaacaaagaaaataaggtctctaaagtaagctttacctgtaatatactgcggtgatctatgttttttaagctgttgaaaaatattttccattaattgctgatcagtatcactcacactactattttgatttaaaaggtaatcagttgttgaccattgttttaggtcttttaatacataaataaaattttcgacttcttcaccacaagcttctaataactgtccgtaatgcttgattaactgcgcataattcattatttatttaaggcttctaacttttgagtctgatcatacataacgagtgcatcaataacttcatccatttttccagataaaatagtatctaatttttgaagtgtcaaaccaatacgatgatctgttacacgattttgtgggaaattataagtacgaatacgttctgaacgatcaccagtaccaactgttgatttacgttcagcatcttgttcatcttgagcaatttgcgcaaaatggtcagcaacacgagcacgaatgatcttcatcgctttatcacggtttttttgctgagtacgttcttcttgcatttcaactttgattcctgtaggaatgtgtaccatacgaactgcagtagcaactttattgacgttctgaccaccagcaccagacgcgtggtaaatatcgacgcgaaggtctttttgatcaatttcgtattctacttcttcaacttctggcattaccaaaacagttgcagttgaagtatgaacacgaccctgactctctgtcaccgggacacgttgaacacgatgagctcctgattcatatttaagcttagaataaactgactgaccagaaaccatagcaaccacttctttaataccaccaacaccattaacggatgattccataacttcaaaacgccatccttgagtttcagcatatttttgatacattgttaaaagatcaccagcaaaaagcgctgcttcatcgccaccagcagcaccacgaatttctaaaataatgtttttatcatcgttaggatctttaggtaatagaaggatttttaatctttcttcatactcttctttagctgcttttgattctttaagttcttctttagccatttcttccaattcagcatcaccagaagcatctttgatcatttcttcagcatctgaaatattttgaatgacttgcttatattctctataagctgtgacagtttctcgagtactagcttcttcacgtgataattccataaatcgctttgtatctgaaacaacatctggatcactaagtaactcacctaactcttcataacgatcttcaactgcctgcaattgatcataaatattcatttttctttgtatctcctttaaaaccgattaccttttaaatatctggattaaaataatgttttcgacaaactgggatatatgtttcattaccaccaatttgtatctgatcaccttcatagacaggttttccgttttctgtccttaaaaccatggttgctttcttactacagtattggcaaattgttttgatttcatcaatcttatcggccaataatagcaaatgttttgaaccttcaaaaagattgttttggaaatcatttttcaaaccaaaagccatgactggtacatctaagtcatctactactctagctaaatcgtagacgtttttcttactcaaaaattgacattcatcaattaaaacacaataaggcttttgtggtaaattctgaatataggagaaaatgtccatatcatctgaaattggaactgcttcacgacgcattccaatacgacttgaaacgactccaaattcatctcgagtgtccaaggcgcttgtcataataaccacaggttttccttgttcttcatagttatgagcaacttttaaaatttcaatggttttaccagaattcattgtcccatatttataatagagttgagccaaagcggaaaatcctactttctatagtattctacctattttaccacaaaggctgaagttttcccagccattgaaaacagtgtgtactttttcacaacattatgttacaatgatgcccaataacataaaggagtaacattatgccatttgtaaaaattgacttgtttgagggacgctcacaagaacaaaaaaatgaattagctcgcgaggttactgaagtagtatcacgcattgcaaaagcacctaaagaaaatatccatgtttttatcaacgatatgcctgaaggaacctactatcctcaaggtgaacttaagaaaaaataagaaatagtaaaagaggttacccaggtaacctcttttgatagtctttgtaagcatatttcttgacaaattgaaaatatttgaaaataagtgttgattttcaagttagaaaacggtatcattagaatatattgctttggaggtggaaaatttgcaactttctcatagtttaagactcatgggaacgactatcgatattcaaattaattctaaaaatgctcaaaaacaaatccgagaggtcatagaactcttggagctctacaaaaatcgctttagtgcaaatgactttaattcagagttaatggctataaataacaacgctggtatcaagcctattcaagtacatccagacctctttgaattaatcacaattgggaaagaacacagcttagctaggcctagtaacctaaatattgctattggtcctttagtgcaaacttggagaattggattttcagatgctaaactacctagccctagtgaaatatcagaagctatgattttatctgacccaactcatatacttctagattcaaataaacaatctgtttttttaaatcagataggaatgaaaattgatttgggtgcacttgcaaaaggatatatcgctgacaaaattatgacctatctcaaaaatgagatgattgattctgctattattaatttaggcggaaacgttttagttcacggagataatcctaatcgttcagaagggtattgggttatcggcattcaacatccgaaaaagaaacggggaaaaaatattggaactgtcaaaattaaaaaccaatctgttgtaacctcaggtacttatgaacgccgtctgattattgacgataaggaataccatcatatttttgatcgacagactggttatccgatacaaacagagatggctagcatttctattgtttctaaacaatccgtcgactgtgaaatctggaccacaaggttgttcggcttatccattaaagaggctcttgatattttaaacgctgtttcctacattgaaggcattatcatcactaaagatgatcgtatctatttatctgatggcttaaaacatcattttcaactattttatcattaagaaagaggatttctaatatgaaacttattggaatcgttggaactaactcaaataaatcaacaaatcgtcaattattacaatacatgcaacaacactttgctgacaaagcagaaattgaactcatcgaagttaaagaccttccgttatttaataaacctgctgataaaaatgttccccaagtaattttggatattgctgctaaaattgaagaaactgatggtgttattattggtacgccagaatatgatcattctataccttcggccttaatgagtgttttagcttggctatcatatggtatttacccacttctcaacaaacccgttatgattactggtgcttcatatggaacacttggatcatcacgtgcacaattacaattacgtcaaatacttaacgctcctgaactaaaagcaagtgttttacctgacgaattcttgttatcacactctctccaagcctttgataaagatggcaacctacacgatatcgaaacaagtcagaagctagatgctatctttgatgattttcgtctttttgttaagattactggtaaattatcaaatgctcgtgatttacttcaaaaagaagcagaaaattttgactgggaaagtttataagagtatagaagggaataactaagatgaaatttgtaggtattgttggctcaaatgcagagcaatcatataatcgtatgttgcttgaatttattcgcaagaattttaaaaccaaatttgaattggaagtccttgaaatcgatgatattccaatgtttaatcaagaccaaaattgggaagaaagtttccaacttcgtcttcttaataataagattacacgagctgatggcgttattattgctactcctgaacataatcatactattacagccgctcttaaaagtgtgcttgagtggctctcatttgctgtgcatccactcgaaaataaacctgttatgattgtcggtgcttcatattatgatcaaggcacatcacgtgctcaaatacaccttcgtaaaatccttgatgctcctggcgttaatgcttacacacttccaggaaatgaattcttattaggaaaagctaaagaagcctttgacgataatggaaacattatcaatcctgggactgttcaatttttagaaacttgtcttgataattttatcaaatatgtaggagttgtatcatcattgagaaaacctaaagctattgaatctgaagacctctactgtcagggacaaattgatacaaccattactggtatcgacccagatgatcctgattggttagacaaggcagctgagaaagttaacgccgttgaaggggatgcttacgttaaactagacaatggtttacttactgttaaccaacttaatatgtttttaaatgctatgccatttgagctaacatatgcagatgataataatcaatttctatattacaataataatcatccagatccagatacaatgttaggaaaacgtgttcgtgaacaagtaggaaaccgtatggctacagttcatggtagtttaccaccggcacgaatgaaaaatgttgaatgggttatcggtactcttcgtaatggaaatcaagaatatgtacgtacagtcgttcctggtacacctccagaagttatcaatactcacaactatcaagctatgtactacccagacggatcttatgctggtattaatgaaattatctttaactttaaaccgtggttagattggtacctccaaactactggacaacgtttggtcggtggaactactgctgctcctggagcttcagcagttgacgctacttctagcgcttcaactagcacaggggatgctcccgtggatcaagccacagatgccacttctggtgcctctgaacattaatctcctcgcttttgaggatctgataccttaaaaagatatcaagatcctcctttttaatatttaatcaagttaataaaatcacataaaaggaatatactatgtcactttttcaagaaaaaattgcttacaattgcgctaaaaaggaagcgctttataaagagagtttaggacgctacgccttgaggtcaatgctagctggggcttatttaacaatgagtactgctgctggtatcgtcgcagctgatactattggtaaaatctctcctgctctatcaggttttgtatttgctttcatctttagttttggacttatttatgttttaatatttaatggtgaattggcgacatctaatatgctttatctcactgcaggagcctataataaaaatatctcttggaaaaaagccatgacaattttaatttattgtacttttttcaacctcgttggtgcttgtatattagcttggttgtttaatcaatcgtactcattccagcatttaacaaatgatagctttttagggcatgtcgttgctaaaaagttaggaaaacctagttcaggagctttcctagaaggtattattgctaatatgtttgtgaatttagctatccttgcttacatgttattaaaagaagaatcggcaaaaatgacggttattttatctgctatttttatgtttgtttttctatcaaacgaacacttaattgctaattttgcatcctttatgttagctgcttttagccatatcgaacatattaaaggttttactcttctaaacattatccgccaatggacacttgtattctttggtaactggataggagggggcgttttcatcggcctagcctatgcttggttaaataaaacaaaaacttctcaccatgaataaaagaaaaactgagtaataaattactcagtttttcttttatattctcatcatgaaatcaataactaaaaattaacttttttgataaataaaggaaagtatcatattaattttttaggcaatccattcaaaatgatatttaaaacaacagctgtcagggttgagataacaataccatttgtcaaaaacatttgtaaagtattaggaagactaatgaagagatttgtcccattaaaacctactcctgctgcaattgatacggctgcaatgataaagttatgctcattatgctcaaaatcaacctgattaagcattttcatcccttgaagtgctaccataccaaataaaactaacatggcaccaccaagaactggacttggaatcatttgagccattgcgccaaatttaggtaacaagccaagtataactaagaagagagctgtaaaatatatcggcttacgcgtacgtatcccagatatctgtaccagtcccacattttgagaaaaaccggtatatggaaaggtattaaataagccgccaagtaatactgccaatccttctgaacggtaaccattacgaagtctcttactgtctaatttatcgtttgtaatatctgaaagcgcaaggtaaacacctgttgattctaccatagaaactgttgcaataatacacatcattaaaatagaagtaaattcaaatctaggagctccaaaataaaatggcttcggaatatgtacaagtggtgcatctgctaccacagaagcatcaactaagcccataaatgctgcaagaattgtacctgaaatgagcccaataaggattgaaattgacttcaaaaagccttttgcgaaaatattaattaataaaacaacaccaatcgttaccagtgataaagttaaagattgtaagcttggctcttttgcattatcacccatatttcccatcgcaactggtattaatgtcaaaccaattgtagtaataactgatcctgttacaattggaggaaagaaatttgcaactttagaaaaaatgccagcaactaaaacgacatatattcctgaagcaattaaagctccaaacatatagccagaaccttgttgtgcaccaataattgataaaggagctacagactgaaaggcacaccctaatacaactggaagacccactccaaagtgcttacttaatcgtaattgtaataaggtggcaatcccacacataaaaatatctgtcgcaataagataagttagttgcttagcattataaccaagagcactagcaatcatgataggtacaagaatggatcctgcatacatagctaacaggtgttgcaagcctagaagtgctgcttgcgaattactttgcacattaaatttcattaagcatcagcctccgcaaaaacaactcgaccattttcaaacgctttaatacgggcaagagaagtaactggaacacctgttttttctaacaaatcacgcccatcttggaaagatttttcaataacgattccgataccagcaaccttagctccagcttgaccaataatttcaagtaatcctttagccgcttgaccgtttgctaaaaagtcatcaatgatgagtacagtatcatcgttagataaaaagcgactcacaatagaaacttgactcgtaacttgctttgtaaaagaatacacttcagcagttaagataccttcagtcatagtaatgttcttagcttttttagcaaatatcattggtacgcccaatgcttgagctgcgtacactgctggcgcaattccagatgcttcaattgtaacaaccttcgtaatgccggcttctttatatttatcagcaaaaactttacctatttcctgcattaactcaaaatctacctgatgagtcaaaaaagaatcaacttttaaaatgttctcacctaaaacatcaccatctttaagaatacgttcttccaataacttcataataaccccttcactctttagaaaataaaaaaataacttacctcaatcagaggacacaaatctcctctaatttatcgcttcattaacatgaaccaacaaggcaagctatttattagcttacttattgttagacattacggtgtcttgtagagacgctaagccaatcctcagcataaataagtaaatcatatatttaattgttatgtatgatagataactattgtaacatttttaattaagatttcaagatttaatttaaatggaatcaccattccaaatagaatttttaacaataacgtaatcaacgtgtctcaagctatccaattcttttcctcctgcgtaagaaatagaactttgcaaatcttgttgcatttctgtcaaagtatcctctagtcgccctttaacaggtaatagaattttcttaccttcaacatttttatgttctcccttttgatattcagaagctgagccatagtattctttaaattgctgtccttctacttccacaagttttccaggactttcaaggtgaccagcaaacagcgaaccaatcattaccatactagcaccaaagcggatagattttgcaatatccccatgtgttcgaataccaccatcagcaataattggcttgcgagcagctttagaacaccaacgtaaggcagctaattgccaacctccagtaccaaaacctgtcttgactttagtaatacaaactttaccaggtccaataccaactttagttgcatctgcacctgcattttccaattctctaacagcttcaggcgttcctacatttccagcaataacgaaagtttctggaagctcttgtttaatgtgttggatcatctctataacactgttagaatggccatgtgcaatatcaatagtgataaactcaggagcatcttctttcagacttgtcacgaagtcatattcatagtctttgaccccaaccgaaatcgatgcaattaaacctttatcatgcatacgcttgataaaaggttttctttcttcttcattaaaacggtgcataatataaaaataaccttcacacgctaatgtttcagctacctcttcatcaataatagtctgcatattagcagggattactggaagtttaaaggtatagtttccaagtttgacacttgtgtcagcttgtgagcggctagatataatacacttgtttggtattaattgaatatcttcataatcaaaaacaggaatatcgttaaacataatggttctcctaatgagtaaaatgaccttcctataactttgtataacaaagcatcgctaggtaaaaacatacctttcctttttaaattatagactttatttatttttagtcaatttttgatcaatttatttgaataatgttcgttttttttaaaataaatgtaaaatcctatagagcagtactctataggattttacatttattatattgcttttctttttcgaagataagttaatcctacaatagctaagataacaacaacgataacgaatagaactgcaaattgactaccaattatagctccatttttcggaatagctacttgtccgatggtaaaaatttgtgaggctactgcggttgcaaaagctcccgcaaattgttgtagtgtattcaagatactattaccatccgctgactgtgctggctttagttttgttaaagctgtcgtaaccatattacttgctccaatccccataccaattttagtaaggatatcaaaggctaaaagtactacaacagacttcgcaggaatgaatatagctgtaccaattaaacctatcaaagaaagggagatgcctatcataattggcttaaatgcaccaattttatccaggagataacctgcaaaaggggataaaaaaactactgctattgcacctggaaacataaacaaaccagctttggttgaagtttgatgtaaaacaagttgcaagaggttaggtaataagaacgaaagtgctagaggaatcatttgaaaagccaggacgccatacaataagattgagaaatctttatctttaaaaacattcaaattcaaaaattctagctgtttatttaaatagtaaaaaataacaaaactaacaatagctactaataagtaaaaaatagacatcttttcaatagctaaaagaagggttgccaagccaatacctaaactgataaaggcaggaaaattgagtttatcattaattcttacttgacgtttgggaatagaagccaaacctataaaggtggatatgataagtattggtgccagaagcataaaaatcatcttccatcctaacattcctgaaataacaccgccataagtaggtccaactgccggtgctaaaagtgtgaccatagcagctactcccatcattagtcctctacgctccatcgggatttgtgtaagaatgatatgaaacaataaagggagggctaatcctgtcccaacaccttgcaaaactctccctactaacaatatagctaaattaggggcaaagctatcaattaaaacaccagataaaaaaagcacatttgccaatgtaaaaatttgtctctctgataaatttttaatcataaatgctgacaaaggcacagtcacagcaacagctaacaaatttcctgttgtcacccattgaataacagcggggttaaccccaaattctttcatcaaaagcggaaaagtgacattcatagatgtttcaataagaatccctgaaaaacctaatatagccgttgtaattatggcaggcataatacgccatccctttttagtcattaaaatctccttgctttgattattatcataaaatagagcaccccgctaaatcaaggtgctccatttaattcattcgaattaaaattaaattgtttatattagttgtcaaaggacaatcaacagctcttattatatcaaataaagctaagaaaaacaaagagttttttgaatattaatgtcttcactttcttatctattctctactcatcaatcaccacttcagagaacataacaattgcaatttactcttaataccgttatcatgttcatatgctaatacccaagaaaatagtggcttttgcctcaaatgaatctgaaaataatttctttattacgttaaagacttactttaattatttattttctatacaaatcattacagatatttcaactctcaatcatgcagattttgacggtagctttgcattccatgatatagaaactagcatacctcatctggtaattgactccaactacttagcgattagtcagactaactcaaaaatagaggctaacgatattaaaacgttctcggaactctccaaaacaatgaccgagtttcactatatgctaaattttgacttatttaaccatctcccatatcgttttagattgcataataaggacggtcaaacaatttattcgaaccataaacctgaagatccttttgatatttatcctgaagaagaatatcctatagacaaatgggttcaaaacagcctaatagagaaaaaagcgaaagagctacatttactcttacctagcgcatcacaagattatattctagtacaatcttataaacgcttagaaaatgatagtgggcaactagttggttatattgaacatgttcataatattaaaccactgctagagggttatttaaaagaatccggtcaagctatcgttggatggtctgatgtcacgtctggtgcttctatctctaacgatgattttgaactataatccactcgtcactctaaaaagaaaactaataactaaaaggcactggtttaatttcagcgccttttattaatcaatctccagttgttgtaagttcacttttttctttaattggtagacctcgattagctgtaaaaatcaaaggaactacttctgttgtaacttcggaaaattgtagaccaaaccatcgtattggtgttgctgtccaatgctttatagatgatttcattagcataacaaatcgttcaccaggttttaggttttgactacttgagaaacgttcatcaaggacaataaacctaaaatctcctacgttactatcaggtctaacgctgtatgtctttccttgtttaggcagacgtccactttcaagtaattcttctacaatcgtacgaagatagcgtgacacagtctgacgcatcttaaatccaaggtaaagttctaccttcacaatgaagtctgttcccatcatgtcaactttatactcagctgtataaggttcatcagtgaccttaatgtttacaaaccaataaacttgtgcttttttagggcgcttatcaaggatagaatacatgatagacttatcaatcatgtcttcttccatacgatttgtcaaataaacaacgttagtatgataaatcggataacgatgatcatgtctaagtttatctaattgtccgatgtaatcttttaaatccaacaacttaacataacgcgaaacaattttactacctttataccagatagtcatgatgaatataattgctactgctataataacaacaacatagcctccatgcataaatttaacagctgaagcaaggaagaagattccctctaaaataccaaagaaaatcatcatcaataagactaaacctctttttactcctttttgaattaaaaagaaagacagtaaaatagttgtcattagcatcgtaattgttatcgctaatccatatgctgcttccatgtgcgctgaagtcttaaaaagcaaaacaatagaggttgtaatggcaaataagaaccaattaataacaggtatgtaggtttgaccaatattgtcaccaggataagttgaacgaaattgcgggaatatttttagtcgcatagcttcagaaactaaggtaaatgatccagaaatcagtgcctgtgaagcgatgatagctgccaaagtagctaaaataacgacatgcattgtaaattgcgaagggatactagcaaaaaagggattcaattcatttcctgcgttcttattagctaaaatccatgccccttgcccacaataagaaagtataatggcaaccttaacgaacggccatgaaacatgtatatttccacgcccaacatgacctaagtcagagtatagtgcttctgcccccgttgtcgccaggaaaatagatcctaaaataaaaatacctttatgattctctggactaaataacaatttcaaaccgtagtatggattaattgctttgaaaacttctggatgggcaaaactattaaggagaccgctaatacctaaaaaggcaaaccatataaacataattggcccaaataatttcccaatcacacccgttccaaacctttggatggcaaaaagtaacagtaaaataaacaaggtcgcaaaaataacgttactctgattctggaaaatatgctgcaaactaggaactacttttaatccctcaacggctgaagttacggttacagctggcgtcaaagctccatctgacaacaaggttgcacctccaataacagctggcacaattaaccaaggtgtcatttttcgaacaagggtatataaagaaaaaataccaccttcgtggtgattatccgcctttaaagctacaagcacatacttgatagttgtaataagtgtcagagtccatatgattaaagatatagaacctaagataaacgattctgtaacactagaaataccaccttggttttcaaccaatgattgcattgtatagagtgggcttgtaccaatatctccataaacaatgcctaaagcaataataaatcctgcttttgatgctttatcaaaagaagaatgattgacatgttgcatttctgccaaccctccgattaaataatattagtcaaaaaaatggctgaactcattatagcagattaagttaaaaaaacaacacttatctataaaaagaccagaaattattaaagcgtttcctggtctttactattttaatcacgataaacaggttgaggtccataagtttgactgactggcattatttctatgcgattaatattaatgtgttctggttggctagcaacccatgacacggtattagcaatatcctctgcttgaattgcatgcgcaccttcataaagtttttcaactcttttatgatcccctttgaaacgtacagttgaaaattctgtcccttcacataaaccgggttctaggttagtcactctgattttagttccagctaaatcggcacgcaagttgagagaaaattgttttacaaaagcttttgatgcgccatagacattagctcctggataaggaattgttcctgcagttgatcccaaattgataattaaccctctattaacttctaccattttaggtaaaatgcatcgtgtcaagtaaattaatcctacaacgttagtattaatcatagtcatccaatctccaaaatcagcttcatatgatttatccaatccaagtgctaaacctgcattattaaccaacaaatcaattgattgcaattttttaggcagactttctaaagctttgtcaaccgattctctacttgtaatatccagttgaagtggataaaagtgaccctctgaaaacttttctccaaggcattttaatttatccattcgacgagcacaaccaataacgctataaccatctgaaactaatttagtaacaatagctgcaccaaaaccagcagatgccccccgtcacaagcgcaactttacgtgatatcatagacactcctcctctagtatatagaaaaacgagctaggaaaaatccttctcgttttataaattattttgatttctcatcaatagcttgagcagctgtaatgatagcaagtttataaatatcttcagcacttgatccacgtgataaatcatttactggagcattcaatccttgtaaaatcggtccgattgcttcaaacatacccaaacgttgtgcaattttatagccaatatttcctgattgaaggtctgggaaaataaaaacatttgcttttccagcaacatcactattaggagctttaatttctgcagtttccggaacaaaagctgcatcaaattgtaattctccatcaacagctaattcgggagataaatctttggcaattttagctgcttcttgaactttttcagcttgaggcgcttttgcacttccttttgttgaaaaactaagcatagcaatcttgggatcaatatcaaatattttagctgtatccgcagtatttactgcaatttctgctagctcttgtgcattaggatcaatgttaatagcacagtcagcaaaaatataacgttcctgtgtattttcacggttcatcaagaatacacctgaagtgcgtgaaattcctggttttgttttaataatttgaagagcaggacgtacagtatcagctgttgaatgaatggcccctgataccataccatctgccaaaccaagttttactaacataaccccaaaatagttaacatccttcaaaagacgatctgcatcttccatagtagctttgcctttacgaatctcaacaaaagcttctttcatctcttcaaatttttcgtattgttcagggtcaataatgctataatcttgatcaacaaaaccaagtcttgccaaagaatcgtgaacttcgtcagccttacctaaaataacaggatcaacaagaccttcaaatttcaaacgagctgctgcacgtaatacacgttcatcgcttccctcagggaaaacaatcttaacataatcacttgcaactttttctcttaaaccaccaaataaggaacgcatatatataaaaccttctatttctaaattaatgtaattccatgataacgctgtcaaagtcatctgtcaagtctagcgtctgtttatttatttttcccataaaagggtcgtaaaaagacaaagaatgacaatgcaatgcttgcctgtttattcctagatccatacgtcctccgtacaaatcatctcccaaaagaggaaagccgatatgagcaaagtgaactctaatttgatgagtacgccctgtatgtaatttgatatccactaatctaacatcaccataacgagcaactacttgataactagtatgtgcatatttgcctgattcatggacgcgcctcgtaataatactatcaacatctcgtgcaataggagctataatatcaccactatctgctaaatcaccactccctgatactaatgcataataccttttttcaattgctttagcctgaagttgtttatctagacgagcatgggcataaccatgcttggcgaataacattaatccacttgtatctcgatccaaccgggtcacaatatggacctgctgattggcatagttattagacacataatagtgttttataaaattagcaattgtatttgaatgaatagagctaggaatactagcgaaaccaaaaggtttatttaaaatcaaaaaatgatcatcctcataaataatatctaaatcgtgaggcactggttccaaagtttcgtgagaaggctcgtcaggaatatctattgtaacaacatcgccaatctctaataagaaaatagcgttctgctcttcaccattaacaaaaatcttaccacctctgtacttaatctttgctaataacccccttgaaacatcatgacttttcaaaagtgttttaactttgcacctttcttttgctacgtattcaaatttcaatgttcaggttctccgataaaagcatcgttaacacgttcccaaaaactagtgtgacttggagttgaaacaaagttaatacttttttcgtcaatactatattctattttggtaacattcttgtaatggactgttttgttatctatagaaattgtatagacaccaactcgtttaggaactatctctatagcatcttttttggggatgataaccgatgaccccaaggtacgatagacgcgattattaagactagaaatttctgttagttgcaaggcttctatcgttgggtggagtactgccccccctagtgatttattgtaagcagtactaccggttggtgtagaaactaaaatgccatctcccctaaacctttcaaataccacttgattaataacaacatccgctaccattgttttttcaatacgcttaatagtagactcatttaaagcacgcgcacgaataactcgaccatcttcaagggtaatagttactttcaaaatgggataggagatttgttcacctttatcatttttcaaattattaattaatgtgtcaacttcaaaatctcgatagtctgtataaaaccctaaatgtcctgtatgaacaccgacaaaccttactttatccagttgtttttcgtacatgtggaaggctgacaaaagcataccatctccaccaatagaaatgacaatatcaggatccttttttgataaataaaaatcaggatcatgtttaaaagcagcaaagagctttgaggctacacgcttgctttgatatttcccgttagcaattatagcaacacgtgttgctctatctgtaaaattcatctgtgtcatcactatttcctacaccatcgctcaattttcgatttaaaggatcaaataaaagctgtgcttcacgaatatcttcgcgaatcttacgcatttcttcatccaattctaaagcgatttttgctgttttctccagtctttgtttaatttcttcagggaagtccccctgatacttgtaatttaatgaatgttcgatggttgcccaaaaattcatagccagagttctgatttgtatttctgctaaaactttcttttgtccatctattgtgtctacaggatactctacaacgacatgatatgaacgatatccactagatttcatatgggtaatataatctcgctcctgaaccactgtcatgtcatgacgttttctcaataaagcaaggacttcatcaacgtcatctacaaattgtaccatgatacgaagccctgcaatatcttgcaagtcctgagcaagattttcttctgaaataccacgtaaaaccatcttttcttgaatactttcaaccgactttacgcgtccagtaacaaattctattggagagtgacgattttgctttctaaattgtttacgaataccacgaagctttatttttaattcaccaaccgtttgaatataagggtctagaaatgtttcccaatccattgacattctaatcctccaaaatatttaatgtactctcttgtaaaataaactttttttctataaaattaacacaacaattaatattataccatatttaggaaaaggaagtgataagatgacacacctagaaattgaatacaaaactctattgaataaagacgaatttaatcgtctaacaagcttattttctcatgttcaacctattactcaaaccaattactattttgacacagaaacatttgaaatgaaagcacaccgaatgtcacttcgtattagaacgttacctaaccgtgccgaactaacactaaaaatccctagagaagtgggaaatttagaacacaatcatgaccttactttagaagaagctaaatatatcgttaaaaatggccaattccctgaagatactgagattgcttctttaatccttgaaaagggagttgatccaaccaaattagctgtctttggacaacttacaacaacaagacgagagatggaaacttcaatcggcttaatggctctagacagcaatatatatgctgatattaaagattatgaacttgagttagaagtcaaacaacctaaacaagggaaaagagatttcgaccagtttttaaaagaaaataatattaattttaaatacgccaaaagtaaggtggctagattctctgctactttaaaaaataactaacgttgagagattggattttccaatctcttttataattctcatttaagcaagaacttaaaatctcatactatctatcctcaacattgttattgcaagcattttcatgtttcttatcgtgaattttttctatttttttggtaaactattagtatcaatctaaaggagtcatctatctcatggcagaacaatacgccgataaacaaatcaaacttttctcattaaccgctaatagagaaattgctgaaaaaatttcccaagcttcaggaattcctttgggtaagatgtcatcacgtcaattctctgatggcgaaattatgattaatattgaggaaacggtgcgcggtgacgatatctatatcatccaatctacaagcttcccagtcaatgataatctctgggaattactcattatgattgacgcttgcaaacgtgcaagtgctaatactgttaacatcgtagtcccttattttggatactctcgtcaggaccgcatcgctgcatctcgtgaacctattactgcaaaattggtcgctaatatgttagttaaagctggagttgatcgagttcttaccctcgacttacatgcagtgcaagtacaagggttcttcgatatcccagttgacaatctttttactgtcccactatttgctgaacactataatcaactcggtctctctggtgaagatgtcgtcgttgttagtcctaaaaattctggaatcaagcgtgctcgtagtttggcagaataccttgactctccaattgctatcattgattatgcacaagatgattctgaacgtgaagaaggctatattattggtgaggtagaaggtaagaaagctattattattgatgatattttaaatacaggaaaaacctttgccgaagctgcaaaaattttagaacgtggtggagcaactgagatttatgctgttgctagtcatgggctttttgctggcggcgcagctgatattttagagtctgcaccaattagagaaattatcgtaacagactctgttttatctaaagagcgtattcctagcaatattaaatatctgacagctagccatctcattgcagatgctattatccgtatccatgaaagaaaacctctaagtccattattttcatatcgttcagataagaaggattaattgatgatttatttagacaatgctgctactaccgctctaaccccatctgttattgagaaaatgaccaatgtcatgacaagtaactatggtaatccatctagtatacatacctttgggcgtcaagcaaatcaacttttacgtgaatgtcgacaaattattgctgaatatctaaatgttaattcacgtgaaattattttcacttctgggggaactgagagcaacaatacagctatcaaagggtatgctcttgcaaatcagctaaaaggtaaacatattattacctctgaaattgaacatcattcagtcctacatactatgacttacttatcagagcgatttggttttgatattacttacttaaaaccaaatcatggacaaataactgcaaaagacgtgcaagaagctttacgagatgatactattatggtatctctcatgtttgttaataatgaaaccggggactttttaccaattcaagagattggtcagcttctcaggaaccaccaagctgtttttcacgttgatgccgttcaagtctttagcaaaatggaacttgatcctcattctttaggaattgactttttagctgcttctgcccataaatttcacggtccaaaaggtgttgggatactttactgtgctccccatcactttgatagtctacttcatggtggagaccaagaggaaaaaagacgtgcttcaactgaaaatataattggtattgctggaatgtctcaagctcttactgatgctacgactaacacccttaaaaattggactcacattagtcagctgagaacgacctttttagatgctatttcagaccttgacttctatcttaataacggtcaagactgcttacctcatgtacttaatataggttttcctggacagaataatggcttgttattgacacaattagatttagctggattcgcagtttcaacaggttctgcatgtactgcaggaacagtcgaacctagccatgtcttaacaagcttgtacggagccaactcaccacgtctaaatgaatcaatacgtattagtttttcagaactaaatacccaagaagaaattcttgaattagctaaaaccttaagaaaaattataggagattaatatggcatttgaaaaagaaataaatcttccagactgcaattacatttacactatcagcccgaacattaaaaaatataccttacgcgatactacattcactcaaaatcgcttaggtaattatgaattagagcgtctcctagaaacagtgcctaattctggcgatggctttcctctaaagattacaatcaataaagaactttctggttttaagctcttaattactgataaatctggccttagaatagtaaatatctttaaatctaccgatcataaaattcttcaagacaaattttatttcttaatggacagcctcgttgagcgtgatatctttacgaaaaccacaaaataatttatcgaccactatttttaacattttagtggtctttttgcgaaccattttgttgtcactttcacaatctttttgtacaatagagatgtgaagaattaagttatataactgattctaaatcgaataataaaatttttaacaaggagataattttgtgattatggataagtctattcctaaagcaactgctaaacgtttatcactgtactaccgtatttttaaacgttttaatactgatggcatcgaaaaagctagttccaaacaaattgcagatgccctaggtatcgattctgctactgttcgacgtgatttttcttattttggtgaactaggacgccgtggttttggttatgatgtcaaaaaacttatgaacttctttgcagaaatattgaacgatcattctacaacaaatgttatgttggtggggtgtggaaatatcggtagagctctcttgcattatcgtttccacgatcgcaataaaatgcaaatttcaatggcttttgatttagatagcaatgatttagttggtaaaacaaccgaagatggcattcctgtctacggtatttcgactatcaatgaccatttaatagatagtgatattgaaactgctatcctaacagtacctagtacagaagcccaagaagttgctgacatcttagtcaaagcaggtataaaaggcatcttgagtttttctccagttcatttaacattaccaaaagatatcattgttcagtatgtagatttaacaagcgaattacaaactttactttatttcatgaaccagcagcaataaatagttcattatttataaaatatctgcttcttctcgaaaactataatatttattttttccaacgatgatgtgatctaggcagacaattcccagatgatcacatgatcgttttatttttttagtgaaacttaaatcactttcactgggctttggagaacctgagggatgattatgtatgataatcaaagaagttgccatgtttttacaagcataatgtagaatttctcttggctctgctactgaacgacgtacagtaccaataaaaatagttctctgttcgataatacgattttgtgtatccatataaatagctactaaatgttcttgttttttatcccctaattcgagcatcattttcctcgctaattgttcactacttaaaatttgctctttacgatcatattcagctttgtgaatccgttttgctagttctagcatagcttttatttcgacggatttaacctgaccgattcctttaatggattgcaactcctgtaaggataattgaccaaaatctgctaaactgcttatgttttctaaaatttgcgttgaaatttccagaacaggtttttctttaatacctgtacgtaagagaatggctaataactcctgattactcaatctatctgcgcctaaatcaactaggcgttctcttggtaataaagcttccttttttaattcaatatggtacataaaacacctccagtcataatattcgtaaaccaatcaaaaactcatgttttaaatcaataaaaaatacttagatgaaaaatctaagtattttttatttaacgataggttcgtgcacaatttctaagcgtttgtcgcttgataatatgatcttttacaatctgatagatagtagctgcaacaggaacagcaagtaacatgcctaaaatcccccataaagcacctccgatagtaatagccattaaaacccacatagaaggcagtccaatcgatccaccgacaactttcggataaatgacatttccctcaaattgttgtaaaaggatcaagaaaagaacaaacaagaatgcttcagtaagcgattcagtagcaattaagatgaaaccgattgtaacaccaatgtaggctcccacaaccggtattagagctgtaaaagcaactaaaaccccaactgttaaagcataaggaaattggaagatcaacataccaataaccgtcaaacttcctaaaatcatagcttctaaagtttggcttacaaaaaaaccatggaaacgttgatgaaggatatgacgaacgtaatggaatgttttgcctgttgaacctaaataggtatcaattaacaaattaaactgacgtcccaactgctccttgtttgccaaaacgtaaattgaaaaaataaaactaacaaaaacattcaggagtgttgccgcaatagaggaaactgaggttagtaaatttgttaaaacagataaaacttgcttcaaaatctgctggctataaccacttaaagtagaaactaagtctttatctgttcccatataatttaaaacctcagaaatttgtttattctcattgagattattaaccaatttagcaagtgctccggtatcaataaccaataaagaactcaaactagaaatcaaatctggaatgacaattgaaaatagccagacaattaaaccaataaaagttgcataggataaaatcatagaaacactacgcttgattgccattaatagtctagatcctttaaaaagctttatatataatcgctcatagactgacattacaatattaataatataggcaattccagctcccatcaaaaaaggaaatattgccttatgaagcgtagttaaaatattagaaacagctccccaataagcctgtatagcatagcaaatagcaaatgttatgacaacataatagacctgccgtttttcaaatttcatgaaatctccttattaatcttaatttctttcaattattatacactattttatgaatgagaaaaagagagttaacagttattagtctgttctttattctatttgactgccattacttgcaataaccttcttgtaccaataaaacgattttttcttgtaacgcttgagtgtcccctctcctttattattgcgatcaacataaatgaaaccatagcgtttttccatttcaccagttcctgcagatactaaatcaatacatccccatgtagtatagccaattagattaacaccatctacatatatagcatctctcattgcagcaatgtgctgacggaggtaatcaatacgataatcatcttctacgtaaccattctcatcaggaatatctactgctccaagtccattttcaacaataaacatcggtttttgataacgatcccagatagcatttaaggtaatacgtaatccaagcggatcaatttgccatccccattcagaagatttcaagtaaggattcttaagagatgcgaaaatattttcttgaacctgttcactgacagttggattacctgaagctactcggcttgaatagtaagaaaatgaaataaaatcaaccgtatagtctcttaacaaagcaagatcttctgctgtcatttgaattgaaatacctaaatgctcaaaatgttttttagcataattagggtatttgccacgagcttgcacatcaataaaaaaataattttctctatttttttgcatcgaagcccaataatcttgtggatgacacgtatttggatagtattgacctgcagctagcatacatccgatttgattatttggatcaacttcatgagcaatttttactgcaatagccgaagccactaactcatggtgagctgcttgatatttaatttgctcttgattttcaccatcttcaaaatataagccagcgcccataaaaggagcgtgtaaaatcatattgatttcgttaaaggtcaaccaatatttaactaaccccttaaaacgagtaaataaagctcgtacaaggcgctcataaaaaccaatcattttacggctccgccacccaccgtaatgtttaataaggtagataggacagtcaaaatgtgtaatggttaccaaaggttcaataccatacttacgacactctttaaaaatattttcataaaactgaagaccagcttcatttggatatagctcatcaccctttggaaaaatacgcgtccatgctattgacatacgataggttttgaaacccatttctgcaagtaatgcaaggtcctctttataatggtgataaaaatctattgattcttttgctggataaaagtatccttcctcaaaatcaaacattttcttttgtcctgaaataattgcaaatcgatcttctccagtaggaacaacatctacatttgctaggccacgtccatcaacattgtaagctccttcgcattgattggcagcagttgccccgccccataaaaaaccttttggaaatacttgttttaccatcatttacccctcttgttttttcttatcataatattaaaaaagaccagttactgacattgattcgccaaatactggtactatccatgacatgaactttctacttagaaggtcttttcactaattctgtgtatttaaatacttaaaaatagtatcaaaacacttttaaaggtagagttttatcgtttcagaaattttagcataggcttgatctgttaggtgcaaaccatcttttgtaaaactgctagcaagctgacctttttcgtcaactaataaatcatacaattcaatataattaatgccagaaattactgataaggttttgtttaaagcttttattgtttgattatttcttaccttgacacgctctatatagtcatcttcttcactaacaggtaaaacactcagtatattaatctctgtcatataagattccgcacgaatttctgcaattatatccgtgatattagctatgatttctgactgtgaatgccctaaaccaatatcatttgttccaattaaaataaatactttggatggtaatagttcccatacttgggttctcaagttttctaaaagccaataagtatctgatcctgctactcctctattaactaaaggatagtcacgtcctaaatgtttttttaaaggaaaaaactcaacgatagaatctcctgtgaaaacaatggcaccttcttgtactgtctgattgttaatctcaaaaaactgttctcgtttcatttgataatctcttaaagctttgtcaataacttctaacatcgttctccttcattattaaatatttctctaggctttcttgtattataacaaaatttcacctgagaattgaatagtatgcttcgttaaaagctacgtggtcctattcattatcactcatcttgtgaagaaagttctctatcgtttctaacacaccatcttgatcgttactaactgtttgatatttagcaatagctttaatttcttctggcgcatttgacatagcgtaagaaatatttgctgctctcaacatttccacatcattgcccccatcaccaaaaaccatcacttgatcctgtttcaatccccacttttcaaggagaatagcgataccatccgctttattgacatcagctggtaagacatcgatacaaccaaaaccactagaggtcaatctgatatgatgatttttaaagtgttcactaatatctaacaacatctcagaaacaagattttcatttacccaaagtgtcatttgaaaatagcggtcatcatctaagggcagcaaatggtctttatagataaaattaggcatatagtattctaattcagtccgcctattaataggagttcttcgctcaaggtatgaacgtttttcaccagataagctgatgagtgtctcaggatagttctgatataaataggataaaacagctgcaactgtatcattagataaataagtttcttttagtaatgtgccatcttggtcaatgacacgaccaccattttcagcgacgtaggcgatacgattagggtattccaaaaagtttaacaacaattgatcgtataaattaccactagcagctacaaatttaatatcatacttctccatcaacgttaataaagaagaaaaccgtgctttatcataagttttatctgagcgtagaaaagttccatccatatctgttgctattagtttaatcatacaagtaacctttgcctttcaagagggtgccaaatatctcaatatgttctttcattatatcacatataaaccaaaaagatttgatacctgatacgtcaacggttctattaattaagttaaattttgtttcagagattaaatcgacttttacctatacttatctccatactatcagagcttgtttaacataatgatttactgaagagttttcttattgttgagttgaataatagattcgtaactattacaatagtcataataaaatatttgagattcgaaattgctatacgtgtttttgagagacctaacattattttttttcacatagttattctgttttgaaaaaataaataattgagtatattaataaatttggtcatattaatacaacaaaaaatccttacatgagataaggagattaaacgaccctgtaaggattttgaagttattagaaacactctaagcaaaaattttaaagcgttttctctatgacttatattatatgtcatgttcctatacaaaacttacactatcctttcaaaaaataatactatcctacgaaacccattttttgatagttttctgttataataatactatcctacgattttagaaagaaaaacgatgaactcacttgataatttactatcacataatttagaagataaccggcatttattaccctatgaacacatgcatactgaggttagaaatggttaccctgacattttatttcactggcatccggaacttgaaatttcatatgtccacgaggggaccgcacgttatcacatcgattatgatttttttaatagccaatctggtgatattatcttgatccgtccaaatggtatgcattctattcatccgattgaaaataaagagcatatcacagatagcattaaatttcacttagatttaataggatattctattgtagaccaagttagccttcgttatttacaaccgttgcagactagctcttttaagtttatccaatgtatcaaacctagtatgacaggatataatgatatcaaaaattgtttgtttgatatttttaatatttcaaaagaagaaaatcgacattttgagctactcctaaaagctaaattaaacgaactcttgtatttactctattatcatcaatatgtcattaaaaaacatactgatgatacctacagaaaaaacgagagaattcgtgatctgattgattatattaataataattaccagcaaaatcttaccattgaatttttagctgattatatggggtatagtaagacacattttatgaccgtatttaaacagcatactggaacatcctgtacagaatttatcatacaagttcgtcttaataaagctagtgaacatcttattaactccactacggccattattgatattgccaacagcgttggttttaataatctatcaaattttaatcgccaatttaaacgctattatcatacaactcctcgccagtaccgcaaacaatttaccaacaaaaaagacggtagtacgcttgtctatagaaatataaatacaaaaaaatagaaactagttaaatccatgactagtttctattttttattatttaagcgttaattagtttacatcagctgttcacgtacttctttaatttccgattcattcacaactaaaaaaatggtgtcgccagcattcaagatagtatttcctgatactacagccgatgtcttatgatgaatttgagtcgttattaacacattttctggtaattctaaatctcggacatactttcctgatattttatctgaaacagttaattcaatcaatgtaggtgtcattactttatcttttggattgaaggtcattttagccaacatcgcttcataaataggttctccctttaataaatccatgacaatataagataccatcgttacaattccaatagccattaattgttttaaatcgccaaccatttctgtaaccaaaatcatagctgttagtggtgcttttgagattgcaccaaaatagcccgccattcctagaacaacaaataaagatatctgctgatgagatattataccaaagtactgcatacctactgcaaaaaaagcacctgctaaagatcctaaagctagaattggtaaaaaaattcctcctggcaagccactactgtaactcaacatactccataaaaaacgaatgaggaaaaataatcctaacatcatcagactaagattactcctaggcagtgatacaattaagccatttccaccccccaataattgtgggaaatagtaaccaataggaagaataaaaattaccgctaatataccatataggtgagatggtagatgaaatagtttgcccaaataatcatagatcacatgaaatcttaaaattacccactcatagataaaacctaagatacccaaaaagagacccatgagtaaaaaaatccaataaaagttgagatttaaagatggtaattctgatggtaaagctaaaactggggttaaaccaaagatattaagtgagacaaagtttgccactaaacttgctaccaaagctgttatccaaactaagcgagaaaaatgatggtaaatttcttcaactacaaataaaaggcctgcaataggagcgttgaaagctgctgaaagacctgctgccgcaccactagcaattaaaacacgtttttccattcgactagcattgagatactgtgcaattcccttgcctgtcatagctcctaactgaatactgggaccttcgcgaccaagcataagtcccgaagaaatagctaaaatacccgcaatgaatttcttccatacaatactaaaccagtctggcgatagcattcctttaagttcaccttcaacatgcgggatacctgaacctttaatatcaggatcagatttgataaaaaaacctattatcactgcagcgataatactagtaaccgtaatgctcaataaaataattggttgataatgggcacttttataaagttccataacaactaaaaaaattttttcaatcgctaatcgaaatatgctgacaacaaatcctgctattaagcctactactattcctctccaaacaaatcccagaattgattcaagtgaaaactgaaattcatttttatgattttccatattttcctccttttcttacaattattttagcaaaaatatcacaaactttctaggaactcttggtaactaaaaatacctctcatcagagaagtacttttagttaatagattacttacgatacattttaaattgtaagtacaaatcattgtaaataccaagccatttttgacccaagttattataaacttctaaatgatcaattgttttatcaggaggataaaatgctttatcatttttgatatctgctggtaacagcgcttttgctttgagattaggggtcgcataaccaatatattctgcattttgtgccgcatttttaggttccatcatgaaattaataaaggcataggcttctttgcgatgctttactgttttggggattacaatattatcaaaccaaaggttcgatccttcactaggaacaacgtaatgcaaatgcttgttcccatcaagcatttctcgtgcttctccagagaatgtaacaccaatcgctgcatctccctgaatcatatagcctttcatctcatcagcaacaatagccttaacgtttggtgttagagcatctaactttttagaagcggcttttaattctgatatgttctttgtattcaatccatatcccaaggaatttaaaccaactccaataacctcacgtgcactatcaactagcatgattttatttcgaaactctggacgccataaatcatcccaatgtttaggaggagttttaactaattgatcattataaacaatcccaacagttccccagaaataaggaatcgaatatttatttttaggatcgaaactcaaatttttaaacctggctccaatagcatcccaattagctatctttgaatgatcaagtttaaccagaaggttttcttttatcattttgtcaatcatataatcactaggtacagcaatatcatatgtcgtcccaccctgcttaattttggtgtgcatagcctcattagagtcaaacgtttcgtattgtacttcaattccagtttcttttgtaaatttttttaataaggctggatcaatatagtctccccagttataaataactaacttatctgagttaggtgttgaactactctttttttctaagtaagtggttaaaccaaagaggatcaggataacaagaacaataccgcctaaaaaggaataaactctacgcattcttttctcccttctctttcgaaatatagtaataaccaattaccaataaaatactaaataaaaagacaatagttgacaaggcgttaatttccaatgatataccgcgacgtgcgcgtgaatagatttctactgaaagcgttgaaaagccattacctgtaacaaagaaagtaaccgcaaaatcatctagcgagtaagtgaaagccataaagaaacctgaaataatacccgacgacaaatagggtaacataacttctttaagcatttgccaagttgaagctcctaaatcataggaagcattaatcatatcatcattcatttcttttaaacgaggtaagaccattaaaacaacaataggaatagagaatgcaacatggctcaataatacagaagtgaaacctaactgtaaaccaataacagtaaatactaagagaaaacttgcaccaatcataacatctggtgctactaaaaggatattattaagcgataaaatagaggtttgatgtctacgtcttacctgataaatccaaatagctccaaaggtaccaataattgtagctaataaggcgctaagaaaagccaaaaagaatgtttgcactaaaattagcattaagcggctatcctgaaacagttctccatagtgactaaaggtgaatccagtaaaagaattcatatccccacctttattgaaagaataaaaaatcaaataaataataggaatataaaggataataaaaacaagtgctaaatagatatttgcgaattttttcatgctttcctctcctttgttaaccacataatagcaaccatcactaaaattaaaataacccctatggttgagcccatacctttattttgtgtgattaaaaaatgttgttctatggctgtccctaaagtgataactcgattaccaccaataagacgcgtaagcataaagagactcaaactagggataaagacagactgtacacctgctcttacaccattcagagataaaggaaatataaccttctgaaaagtttgccatgcatttgcacccaagtcatcacttgcataaatgagattttgatcaatatcatccaaggcattaaaaatgggtaataacataaacggtaattcaatgtaagctgctacaaaaagaaatgaaaagtctgtaaatagaatctgttttgggccgatacctataaaggttaagaaggcgttaattcccccttgttgaccaaatatccccataaaagcataggcttttaacaaaagattaatccatgttggcaaaataactagcattagccataattgcttgtgttttaattttgtaagcaaataagcagctggatagctaatcaaaagcgttatgaaactaacgatgcctgcatataggaccgagttaaagctcattttaagataggttcctgagctaaaaaacgtctggtaattagctaaagtaaagtgcccattaatatcaaagaacgagttccaagcaatcaaagcaacaggtgctaatacaaataagaataaccaagccatataaggaattgaaaatagactagaggttttcttcatttctctcctcctcgatagcattgattaaaccatcctcatgatcgtcagtgtctacatattcttcaatgcgcgcatcaaattcttcttctgtttcattaagacgcataatatgtatatcttctggagtgaaatctaaaccaataacttcaccctcaatagctttacgagttgaatgaatcatccattcattacctaaatcatcataagcaataatttcatagtggacacctcgaaaaagttgtgtgtccactttaacttgaagttttccttcatcgggtagggtaatttgaagatcttctggacgaataactacttggactgattcattagggcgcataccgccatcaacagcctcaaagcgcttaccgttaaattcaaccaaataatcctcaatcatcttgccagataagatatttgattcacctataaaagttgctacaaaatgattgataggttcatcgtagatatctactggtgttcctgattgaacaatttcaccttcattcatgacgaaaatccaatcactcattgccaacgcttcttcttgatcatgtgtgacaaaaacaaaggtaattcctaaacgttgttgcagttcgcgcaattcatattgcatctctgtacgcaatttcaaatccaatgctgataagggttcatctagtaagactactttaggttgattgatgatagcacgcgctatcgcaacacgctggcgttgtcctcctgataatttttgaatggctcgtttttcaaacccttctaaacgaaccatttttagagtttcttgaacacgtttttgaatttctttcttatccatttttttcaactttaatggaaaagcaacgttttcaaaaaccgtcatatgtggaaacaaagcatagttttggaaaacggtatgaacatcccgtttattagtgggaacatcattgatgcgtttcccatctaagtaaatatcgcctgtactcgcctctagcaaacctgcaataatatttaagatagttgatttaccacttcctgaggcccctaataaggtgtaaaatttaccttcttcaagttcaaaattaatatcttttaagacaacggtgttgctgtcttcaaatacctttgatacatttttaaatgcaatgattgggttagtcaattctcataaatcctccatttttctgactaaagtaagcactaaactactttataatagcgactcaccgataatacgaacttctggttccaaatggacacctgaagttgattcaacggtgttaataacatgttcaataagattttcataatcttgagctgaaccttctgcaatgttaaccataaaaccagcatgtttttgactaacctctactccaccaatacgttgacctttaagatgtgcttcgctaatgagttgccctgcaaaatgtcctggaggacgtttgaacacagaaccacaagaagggtattctaaaggttgtttcagctcacggagataggttaaacgatccatttcctgagtaatcatgagatgatctcctggttttaaggcaaacttagctgatataacaatatctccactctcttgaatgacagaatgacgataaccaaattgcatattcctagcttcaatcgttttgagttcaccctgtggtgtcaaaacctgtgcagacaataaaatatgagcaatttcaccaccgtaagcgccagcattcataaagaccgctccacctacacttccaggaattccgcaagcaaactcaaagccagttaagctatgataacgtgcaatacgagttgtttcaatgagattagctcctgcttctgcttcaataacataaccgttgactgtcacagttgacagtttatcaaacatgataacaaaaccacggataccaccatctctaacgataatattactcgcatttcctaaaaccatccaaggaatattttgactgttagcaaacttaacaatacgcgatagttcaaggcgattccttgggaatgcaagataatcagcaggtcctcctactttagtataagtatatttctttaaaggctcatcaaagcgaatatcgagaccttctaattctttttgtattgttttaatcataacctttatctcaattctgttttattgtgttttatagacacaaaaaatcggcataaaaccgatttctattataccaaaaatataggttgttgacgatacattatcacaatttctgtgtattttaattttaaaatcctaactgactattcgactggttttaaataatgaacttctcctaaattcaatttttcgagatagtcttctagcttagaaccattaggtaaacttagttgaggtgctatttcgagtaacggaactagaacaaatgctcgcttcgtcatatacggatggggtactactaaatcttcttggttaatcacttgattaccaaaaagtaagatatcaatatctattgtccttggaccccagtgctcatgtctcacgcgctttaagcatttttcaatttcttgacaataatccaataattcaaaaggtgctaagtctgtctctacctgacaacatatattaaaaaaatcttcttggttagtattcccccaagcagctgtttcataaatagcggaaatttgcgcgacttttgtcttttgcaaatgatcaattgaaaagagagcctgcttcagaaaagtttctctatcaccaatattactacctaaactcaagtaaacggttgtcatgctcgcctgcgctccaattcaattccaactgattcatagtgcccattaattggtggattgtcttttgtaatctttaatgtaatagcttgtactggatgaaactgtaagaaaatatcttcaacaataacacctgctaatttctctattaattgatactgttcgttttcaacatgatttttaatacagtcaaaaacttcaccataatgaaccgtatcaattaaatcatcagtttgtgatgcttttgccaaatcaagtgatagaacagcatcaacttgaaaaacttgccccaatgtttgttcttccgaaaaagcaccatgataaccataaaaccgacatttatttaaataaatcttatccatattacaccaactgactaattactgtcacaatgtccttatttacttcaacattgtgaacacgtacaatctgacacccctttgctattgcccatgccgataaagcagccgtccccatatcacgttcagttacttccctattaccacctagaagataattaacagtacgttttcgagagatcccaaataacacaggataacctaaatcacacacttgttccaaaccttttaatagttctaaattttgctcctctgttttagcaaaaccaaagccaggatctatccaaatattatcctttgaaacacctgcttctaaagcacgctctgctctttcaagtaagaattcacaaacttcttttttgatatcttgataaacagcttcttcctggttatgcatcaaaataattggaacatttcgttctgctgctaaagatagcattttaccatcatataaacctgaccaaacgtcatttaaaatatgtacacctgcatcaagggctgcttgagctacctctgttttataagtatctattgataacaaaagatcagggtagacctctctaatagctttaatcattggaactacacgtttaatttcttcttcagcagtcacaaatactgcacctggccgcgttgattctcccccaatatctacaattgccaccccttgttcaagcatctcaccaacttgatttaaagctgaatcaattgtggtataagaaccaccatctgagaaggaatcaggcgttacatttaaaatccccatgatacaagctttacctgtaatatcatattgtcctattttcatcttttatcctttttgtattagcgatagaatttcttgtctttcatatcgatcgtccttgtataaaccacgagctaccgttgtaatcgtcttacttcctggttttttaatgccacgcattgtcatgcacatatgctctgcttctatcataacaaaaatacctttaggcgccaaagcatcctctaaagcttgtgcaacttgtgctgttaaacgttcctgaagttgaggacgcttactcgccacttcaactgcacgtgcaagcttactaagtccagtaacacgtccatcgtttggtaaataagcaatatgagctttaccataaaaaggaaccaaatgatgttcacacatggaatagaatggaatatccttgacaatcacaacctcttcatgattttcagaaaagactgcagtgaattgctcctttggatcttgattaagtcctgagaacatttctatatacatttttgccacacgcttcggtgtatctttcaatccttctcgattaggattttctcctaaagcctctaaaaattgataaatagctttttccattttttcttgattgggcattaatttatcctatcctttttaagttgttgtagttttgattaatagtagctcctgacgaacttgagaaataaaataaagggagccagtaatcacatagaaatctttatctgatgtcagatttatatcatgtagccatttcttccaatcactaactctagtgtacgctttaggatatttgtctaagtttattgatttagggtaatcaaagctagtaaccgaaaccggagcgatactagacaatgattctaacatactctctatcggtttagtattaattgcagcaaatagaatatgcacgtttttctgctgatatttttttataacttgaacgagagcatcgacactttcattattatgagcgccatcaatcattacattcggaaagattaattctgtacggcctacccattttgtcatttcaagcccatctttaatggtctgtagggttaactttggatatttgtctcttaataataaactggtagttatagctatgctagcattggaaacttggtgatgtcccggcatttgcaactgaatatgatcaatatttgcttgaggacctatatagttaaaataattttcctcttcttttatataaaagtcattgtgtaaacgataagtctggctgtgggtttccttggcttttatttgaaagacttcttcaacatcctgacgatcattagcatatacgaatggaactcctttttttaaaacacctactttttgctcagctatatctacataagttcgtcctaaaacctcctgatgatctaatccaattgacggacaagtaaccgctaaagccttgaacatgttggtagaatcataataaccgcccattccagcctcaataatgacgatatcaaccggacagctattgccaaaataatagaacatcaaaactgttataacttcaaattctgtagctggttctaggttggtctcaaggtgcaaccgttcaacaactggacgaacagtttcaacaagtttgataaaatcagactctggaatcatttgaccatcaatgctaatacgctctctaaagtcaacaatatatggtgatgtaaatgttccaacttgataaccagaattggtaaaaatatgttgtaaataactagttgttgatcctttaccattcgttccaacaacatgaatggcagataggttgttttgagggtttcccagctgctctagcatccatctcatacgttccaaacctggtttaataccaaaagctaatttactatgaatccattctagcgcttcttgataagtcatcttatttacctttctttaacatcgtatgtacttgtccaatactaaaaactaaaatagcaagccagataaaaataaaacctattacctccccactaacgatagtttctttaaaaataaacaatgctagcaataattggatggttggattgatgtattggataaagccgataatatttagaggagccctcttaatggcttctgcaaataataaaagaggaactgctgtaatgattcctgaaagtgagagtaaaactaattgtaatatattataatcagttagaaaatctttggcgaaaaacactatataaatgagtgcaaacggagcaataaaactactttctaccagcatcgaaaaatcactagataaagaaattgatttttttaataacccataaaaaccaaaagaaagcgctagagttagtgaaattaaaggaaaatgaccagtttgataaactaaaattccaactcccatgattgcaatcaaaattgcaaggctaactactcttgccaggtgttcacgtaaaacaaggaccgacaacaaaattgaaataatcggcatcatataataaccaagacttgcctcagtagcgtgaccatgcgtgactgcaaaaatatagaccaaccaattaattgaaattaaaatactggctacaaacattgtccaaaatgactttttattattaactaagccttttaagtcttttaaatagactgtttttctacccgaaacgagcatataaataagcatagttaaaacagtgaatataatcctataagcaaacgtactatatgcttcaattccagataataatttccaataaagagataacagcccccataaaacataggctgacaagccaaggataattcctaaattatcttttctcaactctcactccttttcgctcaatattaagcacttgaatctgtccacctaaacataatttacttaactctgtgacaattgcttgttctttttctttcgaacacagaaccattaccgtcggtcctgctccagacaaataagtagcatacgcaccattttgagtgctgatttgttttatcacttcaaattccttcaccaaaggttgacgatatctttcatgaaagaggtccctttctatagcccatccagcagttaccaaatcacctttcaacaacgacgcaaccatcacattagcgacgctgcttgaagcaactgcatcctcataactcaatttttgaggtagtacatttcgactatcacttgtttttaattcataatttggaataaaagcgataaaggaactatctggaaacatcacttccaaacttttaatatcatttttcactattgatgaaataactaaatcaccaaaaatggccggtgctacattatcaggatgtccttctaatcgggtagctatctctaatttttctttttgagaaagagccaaatttcctaattgattggctaattctattcctgcaacaattacagaggaagaagagcctaaacctctggccaaaggaatatctgaaaacatttttaagcggtgtggtgccaaatccgacttaacatgcaaagctgtttgaataaggaggttagtatgatcttttggaatatttactaaattgtgttcaactaaccactctgtactttcttctaatacttcaatgattaaatactttgataacgcaactcctattgaatcaaagcctggaccaatattcgcactagttgcaggtacaattatcctcatttcaccctcctattactttgaaaacattgattaactgaatgacaccactctcaggaaactcctcaataaattgagttattttctcttggctaacttcatctgttaatacatagatttcttgttgtttatcacccaatgctttttcgataacatttttcaaacctatattttcttgctcaaagtaccttccaagtgtatcactatcttcagcatttctcaaagaaatagctagatagtactcattgaaaatatcagactgcattgacaacctacacggacaatgataagtattcataggcttaatttttatctgtgatcgaatactacgactaatatcgatgatatccgctaaaacagaggttgctgttggattttgtcccgcacctggtccataaaaaagagactgaccaatccctattgattcaatgaatactgcattcatcacatgattaactgcagctaagggatgcttttgagaaattagtgtcggagaaacgtctacacttataccagttggagtttcacgaagatcagctaccaacttaatggcaaagcccatctcctgagctacttcaacatcctctgagcgaatactagaaatccccttataattaacatcatcaaaatcaataggcataccaaatccaaattgacttaagatagtggctttgtaggcagtatcaataccttcaacatcatttgtgggatcactttcagcataacctaactcttgtgccttttttagagcttgttcataagaccatccctcttcaaacatttttgttaacatgaagttggaggtaccgttgagaattcctaataaacgtgtcattttatctgaggcaaacgaatgcgatagggtccttaaaataggaatgcctccagcaactgctccctcatagaataaagctagacctctagcgtctgctaaatccatcaactcttttccgtgtaaagcaatgagatctttattggctgtcacaatatgtttaccaaatcctaatgcttgactcaaataagttttagctggctcaatcccccccattaattccactacaatatcaatttgtgaatcttgaagaatagtatttatctctgtcacaaagttataagtaaatccctgattgatgaaacgctggcggctttcattatctcttactaatactttatcaatcacaatatcttcgccttctaaagaaagtagcttatgttgattttcttttagcaaatatggaatacccttagcaaccgttccaaaacctaataaagctattttaatagtcatgaatttctccttagaaattgtctctaacttcaagacaaacattggctatattataacaaattaccaatattttttatagggcaaacgcgtcttgtcctatgaaagttcttaaaaagagaatattatttcagaaaagatgatacaataaaagtactttaaaagttaaggagaaataaatggcacacacacctactagtcatcgtaaaccacgaaaacgttccccatggttagctattgcttctgtcttttttttgttaatagctttaatcggcatatttctattcttcaacaatcgttcaaagcaagaaataaaaacaaaaacgaacgcctctagtcatcgaaaaattgtcacatctatcaaaaaaaagaaatggattaagcaaaagactcctgtcaaaatacccattttaatgtaccatgctgttcatgttatggacccttctgaagccgccagtgctaacttaattgtggcacctgacatttttgaaagtcatataaaacgtctcaaaaaggaaggatattacttcttagcccctaacgaggcatatcgtgcactaaacgaaaatgccttacctgaaaaaaaagtcatttggattacttttgatgatggaaatgctgatttctacactaaggcataccctatactcaaaaagtacaaggttaaagccactaataatatcatcactggctttgttcaagaaggacgagaatctaacctcaacgttcaacaaatgctagaaatgaagcaaaacggcatgtcattccaaggacatacggttactcaccccaatctttctctcttaactccagaactacaaacccaagaaatgacactatcaaaacagtttttagatcaaaaactctctcaagatactcttgcgattgcttatccatcagggcgctacaatcctacaaccttggatattgctagtcaatattataaactagggcttacaacaaacgaaggagttgcaacaaaagataacggtttgctttctcttaatcgaattcgtatcttaccaactactagcgatgatgatctgatcaagacgattaaccaataaaaagaagccttctggcttctttttattcttcataagatttaaatggttcatttttacgtggataacgatctggagaaatcgataagcccatttcttttttctcatggaaaagctccactaataacgctagcatcatcaaaatcattacgaatgaaaatggcagagcgacaataattaaaacgttctgcagcgctaacagaccaccagacaagagtaagacaatagcaatcactgccaacaccagcccccaaattactttagttcgattttttgggtttaaattaccatcttctgtcaacatagccaaaacgtacgttgcagaatctgctgatgtaataaaaaatgaaaaaattaaaatgatagcaataatggataaaagccaacctaaagtgtagtgattaaaagtagcaaacaatacttcctctgttgcaaactttgtcaaattagtacccagttgttgtacctgagttgataatgtgccaaatgctgcaaaccatacaaaactcaataatgtcggtattaaaagaactaccgttaaaaactcccgaatgctacgccctttagaaatacgagcgatgaaaactccaacaaaaggagaccaggaaatccaccacgcccaataaaaaatcgtccaattatcaatccaagaacgtttagtattgtcaaaagcagctgcacgaaagctcattccaaagaaattttgtaaataagagcctaaagactctgttagggtatcaaaaatacgaaccgttggtcccaatacaataactaaagctaagagggctaccgctaaaatcaaatttaagttcgataaaattttaacaccttttcctaaacctgataaagctgacataacaaataaagctgttgtaatcaggataataacaatttgaacaaatgcattattgggaacacccaataaaaaacttaaccctccgttgatttgagcagctccaaatccaagtgtcgtagcaactccaataactgtagcaacaactgtggtgatatcaacaatttttcctagccaaccatctgtcttatcaccgaaaagaggctttaaagtgacagacaagaggtatttctcttgctttcgaaatccaaaataagctagagctaaagcaaccaatgcatatactgcccaagcatgtatcccccagtgaaaaaatgtaaaacgaaatgcatcagctaatgctgtttgcgattccttaggtgcaccaggtgtcgaaatagcaaaatgcgataagggttcagctgctccgtagaagaccaaaccaatccccatacctgctgaaaacatcattgctatccatgatacagttgaatattcaggacgtgaatgaggttgccctaaacgtatttgtccaagaggactcataataaaaaagacacacaaagcaagaattgaagtaactaacaacaagtacaaccaaccgaaattggtagatacctgttcacgcaagatttgtgtccaagattgaaaaccacgaggaacaataattcctaataagactaaaataagcgatacaattagtgaacctgtaaatacaggcgtaatatgttttttactcaaaatttcctcctatactaaaatagtatagcatactttaataaatactcctctcattttaaccacctgtatcaagacctctccttgtctcctcaacaaaaaagaaccaaataacattatctggttcttgtgtttgacttagtgattaatcactatttggtgtaaataccaaatgttcgttgacaaaggcatcaaatccaagttggctcaactcacgaccatatcctgaatttttaatacctccaaacggtaattccggtaatgatgtccaccctgaattaataaatgtcatccctgtttcaatctgagccgccacttttttagcatgttctggatcagaagaaaaaacagtgcttcctaaaccataactagaatcattagctaaagcaatagcttcttcttcagtatccactttatagatagaggctacggggccgaaaatttcttgattatagattggatttgctttagtgatattcgttaaaacagttggcatgacgaagtttcctggatgatctatagtgtcatttccaaaaactacctcagcaccgtggtctaccgccaatttaatttgttttaaaacatcatcctttgcacctgcagatgacagtggagccaaggttgtttccgaatccattgggtcgccccatttagcagacttaaaggtctcaactaccatatttacaaattcgtcatacttatcagccatgacaatgaaacgttttgaagatgtacatacttgacctgcattatataaacgcgcaaagaatattgttttactaagtaaatcaaaatcagcatcatctaaaataagaaaagcatcgttcccacctaattccatagacgattttttcaaatttttaccagcttcagctgctattgatgccccaccacgctcagaaccagttaaacacacacctgcaacacgaggatctgatataaggtttgaaacttgatcatacgaagcaaaaatatttttaaacgctccttctggagctcctgcttctcggactaaatcctcaaacgcttgagctgaggcaggacaaatagaagcatgttttaaaagcatagtattacccactataaagttaggggcaaatacacgcataatctgataaaatgggaaattccatggctcgacagcaagtaaaacaccgacagcttgcttcaaatagtaagcctctccatttggactttctaacggaacaggttttaaaaacttttgcccattatcagcataatagtcagctatgtctgcacacaagtccacttctccttgtgcttcagtgaaaagttttcccatatctttagtcataacttcagcgtacttatcacgatccttacgtaataaatctgctactttatgcaattgattttggcgttcttcaacattatcttctttgcgccatgtcttgtagagggcatgcgctatgtctaatgactgttcgagatcactgtcactgatattatcgaattcatgcaatacttcgttagtgtacggataaattgttttatatgccataatgttccctccttttgatatcctcattataacatttatgaaatcgattacaaatatttagctttagacaagatcaccaagttccaaggatagcttgcattgttaaactaactataataatgcctaaccaacacgctgcacctaaaagaattgattttcctccagttttaattagtttgctaacattagtatttataccaattgcccccattgccataacaataaaaaatttagataaaaccttaagtggctcaaagatacgtaacgaaaaacctaatgaagcaactatcgttgttagcaaagaagctaagataaaataaagcacaaacttcggaaatatcttagtaacacttacagattgttctttctgcgtttgtttcatatggtaaatagataatacaatcgtaattggaatgatggctaatgttcgtgtcaatttaacaatagtagctccgcccaaagtattgctgtgattgatagcatcccatgcagtagcagttgctgtaactgacgaggtatcattgacagcagtccctgcaaataatgcaaaaccgtgatcagagagaccaataaaattccccagcgttggaaaaattaaagccgctaagatattgaataaaaaaataaccgaaatagcttgtgctacttcatcatctttagcattaataactggtgcagtcgctgcaattgcggacccaccacaaatagatgaaccaacacctattaaagtagcaatcgttttatctaacttaaataacttttgcaaaacataagcaataatcaatgaaatggaaatcgtcataataatgatgggtaacgatgatataccaactttcatcacttgcatgaggtttagtccaaaacctaataagacaactgctgtttgtaaaatatatttagatgtaaaagcaatacccttattaaataattgtcgattttgataaaaggatccaacaattattccaatcaagatagcaaaaactggtgctcctattaaagggagataaagcccaagcaaccaagatggtatagcaataataaagcataatattaatccaggaattttttccttaaataacatgatagtcctcctcacattgactattatatcacaagctttaaaacgtgacaggaaaaccgaaagaggaccagaatatgctctgatcctctttcattactaattcacaattatttagttactttcataaatggatatgatttttcattacctaaaatcaatttagagccctcttttttataggctgttttttcaccatttttcacaatattaccatagaacgcatttgcctttttattgatatgcgatactttaataacacttgttaagcgatgtactttaccatccataactggcaatgtcatttcaccagtattagtattatattttcctccggcagcttgtgcagcactttgaaaacttctatcaatttgttggtcaatttgttggtcagtgatttttgtttcatcaaaaatctttttacctgcttcacttaaatcattgtaagtcaaaccttgatcttttaattgtttttcaagagctttatcaataaaagtttttatagcttgatggaattttacctcatcaatttgagcagtgactgttatctttgcctcatcgtttttgacgttcatatgcatattagcgcccttaaccaaatcagctgcactaatccccatatccgctgcctgacttccaagttgttgttctatttctttctcaacttgcttctctaaagaaactgtacgccattttccctctagtgactgatgattattccagaaatagagaccgcctgcacctacaattagaataagtactagtacagttaaaaaaacttttaaaaactttttcatgataaaaactccttatgataaactacattaatcataacataatatcacaactccttcaattaaaatagtaaaataattatataaaagtttgtaattttatacattttaataaaacctattatttgtaaaaatgacataatctaaaacatttaattttactacataataattataaaacaattaatctcagtaaaggttttcatttgtatatttaaatattttttcgaattattatattatttgtcgcttttttatggtaatataaaataaatatagattttaaattaatatatacatttctatatttattgatttttatctcagtataacttagtgtcgtagagattaattcctatcattcaccgctttattttaggataactaaacaatttattgtttaaaacgaaaggatttatgaatgtctaggaaaacatttaaacgtatactatcgattggagtttgcacgctcgtactatcgatgagtctttattacactgaaaaagcccacgctattgctggtcctagtgaccgccaatacgtagaaaacccaaatcctcacattattgtaaatgttacaggtactgatcaaaacggaaatagcattttaccgcattatatcgaagtcaatgtaaagatgggacaaactttaagtaaaaaagaaattctagattatattgctcgaaatttaaactctagtgtggaggagaaagtaaaaacgttcaatacagcaacatcgagtttaaggaaagtgcttatctgaagcgtcaattagatgatggcaagacagaagaaatagcaattgataacgacggtgttactgtacctaaagacggtccaaacaaattttggattgacgttccagtaacttgtacggtaaattcaataactccaaagctccataaagtagaatggggtacacctatttcagttttacattatgtacagttcgttgataaaactacaggtaaaactttagaggattttaaaactattgattttgctgaaatcgaccttggaattcgacataccggtgatagcattaccgataaggaactatataactcagcttacagtgcctttttaagaagtaaattaactaagcaaggttatcaattccaatacagaattagtacagatgttcaacaaaatcttcaagtcaccaaaaaactttacaactacgatgtaaatgaagaattgattaactatcaaatcgaaaacaatagacccacactaaacctatctaatgaagccgagactgatatctttttcgaaagatattatgtttctagagatggagatagtttagcacgtacagaatcaacaatttcgattaaaatggttgatgccaaaactgaacaaccgctatttaaccacacattaacgggttatcaattgtcaactgtttccaatgtctataacagactctttgaagaaaatcttatcccaactacaaaatcaggagaaaaatattttattcaaaatatgaaaaaaacagctgaacaagaatatactgtttacctttcagaaacaccttattctgaagagaacgctcccgtaatttcttatgatgcaagacctgttgattgggattatcactcaggcgcttcaggatcacttgaaaatcagcctaacatctatactgaagaagattcaactgaatttttgggtaataaaccacaagcagcttgttatccaaacaaacaatttgcttgcgaaaatactgactctaaatacaactatagctatttagaaaaatagttataaccgatagggttaatctctcattatcttatactgattaaaatcattaaacttgtttccattttgactggaaacaagttttttatatttatttgtcacatataattgacagtcttcgaaaaatgatatatactcaaaatgtcatctatatatgacactcttcttagattctttactaaaggagctaataatcgtgaatcgtcttagagaatacagaattaaagctagcatatctcaattagctttagcaaaatcagttggtgtcgccagacaaacaataaaccttattgaaaataataaatacaatccttcgctagatctttgtataagactagcggaatgcctacaaacagacctcaatactcttttttgggatagtagacatctataacagactagactctctaaatctatgaaaactcgggaggttaggtcgtgttattatttcaatctcaaactttattaaatagttcaaggataggagaatattatgaaagaaaagaaaaatttggggataaaattaataaaatccctatatggtattaatggcccattcgatgaatacagagaacaaaaaatcaattaccttggaaatctattatttgcaaccactagcctctatcacattttatcctctatcatcgcctggttcacggtaagtaaatatcccacagagactgcatatactctcctagctttaacattctttctatatttttgtatttttctaattgttattccctcttatctcaacagtcatgatttaataacgtcactagaagtctcaaaaaatgactatccagtagcaataaagaaaaacaaacaaaaatttatcaaaatcgggatattttatactgtcatccagtggcttatcttgggtttaacaactagcaataacactccgctgattgtatcactattttctttaaaagttattttgtctagtattatgtccggtgtagcttacaatggagttatgtatctaatatttaaaaacaatgttgatattgaaaaagatgaataatgacaacatttcatctctaattgttctcactgtctatataaataataaggctggaaaattttccagccttattatttatggtaatatctttgcagcattaatcgccgcttcgtagtcaacatctgaattaacattgtcaacgtattcggtgtaagtcaccttattatgctcatccaaaataagaactgcacgtgttaacaaatgccactcattcatcaaaagagcgtactcttgaccaaacgaatgatcataaaaatctgataataaaatcacgttatcaaggccttcagcactgcaccaacgcttctgagcaaatggaaggtccatagaaacagtaataaccactgtgttatctagctctgataattcctcattaaaagtacgtgtttgttttgaacaaatacctgtatcaatagaaggaacaacgctaataactttctttttcccttcaaaatcttttaaagatttttgagataagtctgtagctattagtaaaaaatcttttgcaatatccccaacttgtagctgttttcctgtaaaagtaacaggatttccaagaaatgttgtcataagtttacctccttatcaattacctttattttactatgaagcttcttctttttcgaataattgaactgataattaaaggtacttacttccttcgcgtatgctcaaagtcgacaactcatcacaatgattactgataaagtcctttacccatactttattatactttgaataatccctaagcgcccagccaatcgccttattgataaaaaattcttgacttcctgtatttcttaaaataaaaagtgacaaaatatcagtatttgttttttctttaaatcctagttgatgctcaatagctagtcgcctcatccaaaaatcttgatcaagtgaccattctgacagtaaattcataaccttgtcatcttttaaggataagttcccaaaaatcttagtcagaacatcaatactatcccaccactgttgatgacgagcgtaaaactctagtctagagcaatcattataggtgagaaattgactcatagctaatagataatcaagtacaaaatgatgatattcacgatagtcactttgccaacatttatcaagcaattgccaatcaatttttgcttgtcttttagcagcctttataagctctttgtagagcatacgtcgctcaggtgatttaataccatagcacttaaaatgatggcgtaaataagcctcctgttgcttagaaacttctttgtcacttgcagctttaaatttcctctctaaacttaggaataaatccattacgtaatccccttgtatttttcaaaaagcgttgtaattccttcatgtacagattctcttgatacacgtaaattagcgtaaggagtcagttcatcaaaatcccctacttgaacactataatgcgcagcatcaaacatagaaatatcatttttatcattgccaaaagctataaaacgattcccaaataatttcttagtggcttttcccttgtcaactgcaatgggatttatgtacaaacatttttcaaattcgtggaaaaagtgactactaagtccaaaacgatttaattccgctaacatttggtctgcccttcccagctgatcaccaaaatacaacaccatttttatcggtttctcaattttagaaacttctagaagctctccccttttttgaggatcaacataagcaataaagggaattttagaagcctgataagtagcgtaattaaagacctcatcaacaaaatatggaatctgatggcgatgacaatatgaaataatagtactaaaaaagtcactttgtaaatagtaactatccactaagtgaccattttcatgtaaagtcgcaccatttaaaccaataatttttgataaagatagcttgtcgccaaggatacctatagtgtctctataagatcgcgctgtagcaaaagtgactctatgaccataatcaatctgggctctctctagtattccttgtatttctttagatagactcataccatcaaaacaaagagttccatctatatcaaagacaaaatccattctctcaaagtcccatccttaagttaaaataggttttcatacgtgcataaacatcttcatcaccaacaaaaaagatatgatctccttgctctataactgagaaaggccccggagaaacaataaatttcccttcgtgttcaatagccacaatagtcgcaccagtttgatgccatacatttaattctcctattgacttaccaaggtgttcagaatcttcactgacaataatttcatatggtgctagtgggtattgtttactaaccgcacgtgtttgaagcaaaaaatcatcaactaaagtagctaactcttccatttcttgttgctgagccttgatattatcacggattttacctttcaaaatagcaactgaatgagaggtttcatattggtttaagaattcaattgctttttctttagagagaataatggctccactgccatgctttaaagttaaaatctgtaaatctgctaaaatattaagacccttacgtgctgtttctggtgatacgttgaatgttgaagcaatagttgttctagatttcaacttctctccaacttcataatctccatttgcgattctttgtgcaaccgctactgctattttttgatatttagatgttacaatttcagattgttcagaaaccatccaaccctccttatcctaataaaaacatacatattaaaccacaattagcaaaatattgcaaatatatcttttttgttaatatctaatgtctttagtaaatatcatataaaaggagctggtctcccagctccgagtgtcttatcataaaaagtagtttactgaattaagattcactagtacgagcttctgagattttttcttttgcagcctcagtaccatttgatactgcttcttttgttttctctgctccagaggaaattgctgctttagctttgccagcttgttcagaagcaaagtttcctgttgcttgtgctgcatcagatacacgatcttgtactgtcactgagtcagcttcatgttcagctttagtcttaatatctacgacatttgcgttcaattcaacaactttaaggtgggtcatcacttcaacgttttgactgacaatcgctttaatgctttcaacgatagctgggatgtccttgccgtattcaacaacgatgtctaaatcaactgcaacttctttagtaccaacttcaacatttacaccatcagttactgagtcagaatttacaacgctattttttagattagagaagaaacctccactcacagctaagagtccgtctactgattctaaagcatgtccaacaattttagcaattaccttttcttcataagttactgaagttttaatatcttgtttttgattttccataaataaatgacctcaaaccttctagtcctttttcttaaagctctctgaagcacccttaatggtatctttaatgtcagcaagtttttcttttgcatgacctttcaatttatcaactttaccttcagattcaacttctttatcgccagtaagtttccaacagattcttttactgaaccagaaaccttatcaacttttgcatcaaatttttcttcagacataatagcctcctactaataacaatactttaaactacacttaaatcaattattgtacacgtggttcagacttcatgtcttccactttatcaacaccgctacctacggcacttttaacgtttgaaacttgattcgaagcaaattcacctgttgcttgtgctgcacttgttacacgatcttgaagagttactgaatcttcttcatgttgagcacgagttttaatatcaacaacattaacattaacttcaaccacttcaaggtctgtcatacgtttcacttcagcttcaacaacttttttgatatcggcaaagatagttggaacatgtttttggtattcagcaacaatatccaaatcaacagcaacttgctttttacccacttcgacatttacgccatctgtaactgaatcagaatttacaacgctattttttaaatttgagaaaaaaccaccatttacagccaaaagaccatctacatgctcaatcgcaattccaacaattttttcaatcactttatcttcgaaagttaattctccacgaacagctgtcgtgccagaattgttagttgtgtttttgatgtaagtttcagtcataatagttcctctttcttttatttaaataatgtagaataaatataaacgaaaaattttattttctcttattaaagaattggtcaagcatacctgttctttgcacataaagtccagcataagcacctagcacaatgataacaagagcaagaattgttttaaagaatccaatggttacaatcattgcagctaaaacgagcccaataactgcacctcctagtggatatctgtatttcctcacgaattctgacatattagactcctattctacacgacttttattcgtcttagcatttccaacattttcttcttcaacttgcttaacaaatactctagtgttcattttcttttccaacccaaagaattcttttaagccaagttcaacatcactttgaatatgttcaagttgttccggtacatttgtacgagaagttaaaagacctttaacatcaactttcacttttttcttatataaatgagctgtcacactaggagatttcatcaaaccagtttttaatacttctgttttaacaaatccctctattgcagatttttttaacatcaatttaccagttttatcagctagtttatactctgtgtatcgtcttggataaaacagaactaccaatatagccagtaaaacgatcacaaacagcactaatgctccccaaaagaaataatgatacataccaacgtcaatcggtgatggcaaattaaaatcccaatctaaccaattaaaagatggtagataaatgtgttgtttactgataacagctacaaatcctagtagggtaagggagattagacctagtaaagtatataaactttttagtccttttgacataggtaactccttttctagttattcattttacctagtacaaatgaagtaacaatgacaacaataatagcacctacgattgaaggaatcaaagccatacctgctaacttaggcccccatgttcctagtaaactttgaccaacaaatgaaccaactaaaccagctaagatgttagctatccaacccattgaaccacctttgttagtaacagcccctgcaatagcaccgataatagcacctacgattaatgaccaaattaaactcatgataaataccttctctttcttaactaatcattccactagttatgtagttatgattttttgcctaatacaaatgaagtaacaatgataacgataatcgcacctacgattgaaggaatcaaagccatatctgctaacttaggcccccatgttcctagtaaactttgaccaacaaatgaaccaactaaaccagctaagatgttagctatccaacccattgaaccacccttgttagtgattgctcctgcaatagcaccaataatagcaccaacgattaatgaccaaattaaacccatgataaatacctttcttcctaagtacatctcagtgtacaaacttattttgttcttaactaaataacaagagtttcttaagtgaccactcggcaattaattaagttgttaactatactaatattatacaactttataaagtgactgccaagtaaaaagcttggtaaatgcttttatttttaagtgaccacttgatatttaattgatattgttattatactctttttagaaaagaatgcaagagaaacgcttctttttttaaaatagtatggtcacttttagaaaacgctttaatatcaacctttttagtaagtaaaaaccaaatgataacttattttttctattcaaatgatgcaaaaagactaagaatacaattcttagtctctgattatttaagcatataatagaagaaagttagttttcctttttgctaataggagcgacactcgctaataatttctttaacccaatacctggaaaatttatttttaactcttgagtctttccgctacctgaaacttcaagcaccgtaccgtccccccattttttatgagttgcaacatcaccaatctcccatgatgtctcatggctattgttcgcgttaagagcctggagttgggcagttacttgagattgtgaattacttttacgtgcctgaagcgcttgttgaagactcattccttgaccaaattgtgtaggctgttcttttgaatatttcacaccaaatgaagaattaactggtcgagctaacccttggtattgtatcagttcatcatcaatctcacgtataaaacgggttggtctattataactagttttaccaaataaagtacgggtattagcattggtaaggaaaagtatttgttctgctctcgtaatcccgacataagctaaacgacgctcttcttctaattcatcagcatcctctattgcacgcgataaaggaaatactccttcttccataccgattaagaaaacaactggaaattctagacccttggcagcatgtaatgtcattaaagtgacctcagccgtttcagtggcgctatcatcagtatctgctattaaagctaaatcatttaaaaaacgcgatagacgatctaaaccagtttcaccctctactgtaatctctgggttatcgtcaaaatttttagtcactgacaagaattcttcaatattttcaatacgcgcttgactttctaatgtattttgaacttgaagtgcttctagatatcctgtcttatccagtaggttttctgtaatctccgttacagttaaactatctagattactacgtagagtcaaaatcagattagctaaatcccaaacagcttgagcagccttcccttttaagggcgacatcatgacatttgaagaggcatcaagaagagacatgctctgttcataggcaaatgaccgtattttttctaaagttcctggccccacccctcttttaggttcatttacaatccgctcaaaagaaatattatcagaagtatttgcaaggatattgagataagcaataacatctcgaatttctttacgactatagaattttgttccaccaaccattgtatatggaatattggattttaaaagtgcttcctcaatagtacgagattgcgcattcgtacgataaagaacggcaaaatctttgaaattttttccttgttctcgaacgatgttatcaatagttgatgctacaaaaactgcttcttcttgctcgttgttagctctatgatatacaatttgctcaccttcatcattttgagtccataattttttgggacggcgatttttattatgattaatcacattattagcagcttgaagtattttcttagtcgatcgataattttcttctaataatacaactttggcttgcggatagtccttttcaaaatcaagaatattttgcatatcagctccacgccatccgtaaatggattgatcggcatcaccaacaacacaaatatttttgaaacgcgaagctaataacttaactaattggtattgagcgtggttagtatcttgatactcgtctacatggatatattgatacctctgttggtaataggccaaaacatctttattctgatcaaataatcgaagtgtcatcataatcaagtcatcgaaatccatggcctcacttctacgtaattcctcttgataagctttatagcatttagcaattacctgtgtatacatatctccggcttgcttctcatatgcaatttcatcaagaaggtcatttttagcattagagattgtacctaaaattgaacgttcattccacttttttgtgtccaaatttaattgcttaatgattcgcttcattaaagtacgctgctcacctggatcaacgattgtaaagttacgattatatccaatataatcagcttcacgacgtaaaatacgaacacacatactatgaaaagttgcaatcaaagtatcttgggtagctggattcaaggcgatagcacgttcacgcatttcacgcgctgctttattagtaaaagtaatcgctaaaatattccaaggattaacatatttttcatctattaaataagcaatacgatgagtcagaacacgtgtttttccagagccagctcctgccataatcaaaagcggtccgtctgtcgtttgtaccgcttctgcttgtttatcattcattccaattattaaaggattcatttctactcctaattttgtcaaaattgcttctctagtatatcattttttcatctttttcccaatagaaaaaggagttaaacagacgctgtctaactcctaccttttttacttctcttttctctctccagttacaaacattgtaaaaatagcagttgtaaccatttcgcctttctgatttttaatgtgaacatcaacgactttttgtagtacgaccattatgaacacaagtaccgatgacagtaagcagatcatctaatcggcctgccctcaaatagttgatatttgattgtagagttaccgcttcatatcctgttgaaatagcaactaaaccactgacttgatcacacagtgtaaacaaataaccaccatgagcattaccataatagttgagcgaagagtcaacgaccttcgttgttaaggtaacttgaccttcttcccagttttcaatttcgtaattctcaaatacttttacttgttctaaattgaatttcattctactataacctcactttttttatgaccattatagcagaaaataaggaaaccataactgtaaacgtttttattttaaactttttaactgacctattataacaaaagagctcagatactctgagctcttttgtcatgatttcatgctttcttttggcaatattaaatttaatataatacccactatagcacttaatgctgttcctgataaagttagagcacctagatcaaggactgctccaccgaggcctaaaactaacatggaactagcaataatcagattacgaacctcagcaaaattgacacgattttcaatcaacacttttaatccattacttgcaataacaccataaagtaatatagccattccaccaagtactgcactaggaattgtagagatcaaagctgtaaatttaccaaagaatgaaaaagcgattgcaataaaagctgcattacgaataaccgttacagaagctatacgcgtcatgccaataacacctgtattttcaccataagtagtttcagctggtcctcctataagagcagaaaatgcggttgctaaaccatctccaattaaaagacgatttaaacctggtttttttagaaagttacgcccacaaatctgacctaaaactgtatgatcaccgatattttcagcaatcgttacaattgagattggaagaatggcaagcatttctggtccaaagtaaagtttataactgtgaaataaacctgtcttaaacggtaaatagaattttggcaattcaaaccaggcagctttttcaactggagataaatctaccaagccaagaatgattgataaaatataacctccaataattgcaaataaaaatggaataatcttgataaaacctttccctttagtattgataaaagctgcaatcaagaatgtaacaacagcaactagcattttacgccaatcacctttagcgacaaaacctgcattagttacagcagagtttgccaaacctaaaccaataacaataatcataggtccaatgattattggtggcaaaatcttatcaacccatgaatttcctacgaacttaataaccgtcgccacaacgacatagattagacctacaaaaagaatacctgtttgagcagccgaaatatcgccatgcatttgtttcatggctaatgccatagctgtaatataagcaaatgatgagcctaggtaaacagggactttaaattttgtcgcaacttgataaatgagcgttccgcaaccagaagcaaataaagccactgatacaggcatccctaaaataagcggaactaatatcgtagctccaaacatggcaaaaacatgttgaaaacttaacagcaaaccttgaaataattctggtttttcatcgatatctagtaataagttagtagaatgtacttccttatctactagaatttgattactttcacctttagcatttaaagtcatatctaaactagtcctcttgggcatacaaaaaagcccactttctatagcaatatagtcataggctttatttttttcctgatgtttttctcacctcacgggatgagtttaaaaacctacgctgaaagaattatagcataagacattttagaaaacaagacttttttgaaactatattgacaaaactatgctttttcattatgatagttaacataataaaatataccgaatgacgtcattcaggagaagaaagttagactttcgccgaaggaattacactctcaggtgtcttaagacaggactgattgacagacggacttctggagagacctataagtagcaacatctttgtattgacaccaagatgtgctctaggcgccgaaggggcaagaagagtaaaacaactcctccaatctctcaggcaaaaggacagaagctaaaagccaatattaataatgagtagtaagcttaataagtttactactacctttatttgtgcgctttttagctagcatctttcagaagttatctcttttagagataacttctttcgtttcattacagaatccataggtatgtcatgtatcaaaggagaacatatgctaacactttttactcatatcaatagcttcgtttggggtccacctttacttgctttattagtcggaacaggtatttacctatcatttcgcttaggttttattcaattgagacaactttctagagctttcaaattgattttccgagaggataacgggcaaggagatatttcaagttatgctgcccttgcaactgctcttgctgcaacggtagggacaggtaatatcgttggtgtggctacggctattaaatctggaggaccaggagctttgttttggatgtgggtagctgccttttttggaatggcaacaaaatacgcagaaggattattagctatcaaatatcgcacaaaagatactaatggagaaatttctggaggaccgatgtactacattatcaatggaatgggacaaaaatggaaaccattagcagtctttttttctgcagcaggtatcttagtagctcttttaggaatagggacattcactcaagtcaatgcaattgcttcttctcttgagcatactttcaaaatatcaactagatttaccagcctcattcttgctgttatagtattatttattatatttggaggtataaaatctatttcaaaagtttcagaaaaaatagtgccttttatggctataagctatattttagcaactctgattattattgcagttaattacaataagattccacatactttccaactcatctttagcggtgctttttctgggacagcagccattggtggtttttctggagctatcgttaaagaagcaattcaaaagggaattgctagaggagttttctcaaatgaatctggattgggttctgctccaatagccgcagcagcagctaaaacaaaagaacctgttgaacaaggccttatttcaatgacaggaaccttcattgacactattgttatttgtactttgacagggattgcaattttagttacaggaaaatggctagaatttgatttacagggtgctccgttaacacaagcatcttttaataccgtatttggctcactaggtagttttgccctaaccttttgccttgtcttatttgcttttactactattttaggatggagctattacggagagcgttgctttgaatatctatttgggactaaatttattaacgcttatcgcattatttttgtcattatggtcggcttaggtggtttcttacagctcgatctcatttgggttatcgctgatatcgttaatggtttaatggctttacccaatctaatagctctcctagctttgtcaccaattattgttaaagaaacacagaaatatttttcagagactaaaaatatcactaagccttgaacttactagttttatagtctgctcctaagtgatataatgtgtagatgaaaggaaattaggaaaatggcaacttctactgaaaacttacaacttgcaaaaagagggcccattattagtatcattgcctatataacactggcagtcgctaaattagctgcaggttattggtttgatgctacttcacttgtagcagatggatttaataacttatctgatatcttaggaaatgtagcactcttaattggtttacacttggctagtcaaccagccgactcaaaccatcgttttggtcactggaaaattgaagatttagcaagcctgattacctcttttatcatgtttgtcgtaggtattcaagtttttattcaaactgtcactaagattattaataatactgatactaacattgatcctctaggtgctatagtaggtgctatatctgctcttgttatgcttggcgtttatttctataataaacaattatctcaaagagtaaagtctagcgctctggttgcagcttctaaagataacctttctgatgctgtgacatctatcggcacatctattgctatcattgcggcttctctaaattttcctattattgatcgtttagctgctatcattattacttattttattcttaaaacagcttatgatatttttatagaatctgctttcagcttatcggatggtttcgatgattatcaattaaaacaatacgaaaaagctatattaacaattcctaaaatatccgctgtaaaatctcaacgtggacgtacttacggtagtaatatttaccttgatattgttctcgaaatgaaccctgatctctcagtctttgaaagtcatgccattaccgaaagagtggaaaaactactcagtgataaattttctgtatatgacatagatattcatgtagaacccgcttctatcccagaagacgaaattttcgataatgtttatcaaaaattatacaaaaacgaaaaaatcatcctagcaaaaattcccggttatgagacctttattagccctgacttttatatgattaatgaaaagggaaacattatcacttctgacatgctcactaatgctacaaatcattcattggcaagcaactttaaatatttcaatgtaaaatcaattagtcaaaaaacaaaacttgtgtcttatgaattggaaggtaaacgacatactagtatttggcgccgtaatgaaaaatggttcttaatctaccatcaaataactgccaagtcaagtccgtataaaacgagacgatatcaaatcacttcccttgattaatatactatttaatcagttactcttgataaaaatagcttacaaaaataaattaaaaagattgagaagaatctcggtctttttaatttgtttttatgtaaacgtttcatagccttgaaaattactttcagagtagtagactataatggaaggagtttttcatgaaattatacgttcaattaatggttattttaaccttttcattcgctggtgaggttctatctactatattcaacttacctgtaccaggcagtattattggattaatattactattcctagcgttaaaatacaaaatcatcaggctcaggcatattgatgccgtggggaattttctattagcaaatatgaccattttatttttaccaccagcagttggactgatggagcactttcaagacataaagccctatctttttgggatagctatcattatcttaggagcgctatttctcaatattctaactattggactggtatcccaatggatcaaaaagagatatgaaggagattatccagaaattggaggtaaaaatggcaactttaacgaataaccctatctttggtattatgttaaccgtatgggcgtattacattggcataaggatttttagaaaatatccttcccctgcaacaactccacttcttttggcgactattttattaattgcttttttaaaattaacacatatctcctataaagattactacaatggcggttcatttctaacgatgttaattacgccttcaacggttgtattggctattcctctctatagaacctttcatttaatgaagcatcacattaaaagcattagcattagcatcatcttagcttctgttatcaacacagtttttaccgcaatagttgctaagttttttggtatgaaatatttcttagcaatctcacttttcccaaagtccgtaactacagctatggccgttggaattacaagtaaagcaggtggattagctactatcactctggtcgtagttgttattacaggcatcttaacaagcgttttgggtcctatttttctaaaattattaaggatagaagatcctgttgctatagggctcgcgctaggaggaactgggcatgctataggaactggacaagccttaaaatatggccaagttcaaggcgccatggctggactagcaattggtatcacagggatttgctatgttattgtcagtcctttagttgcaggcttaatattgaaatgaggataaggaaagtaaacccaaaataattatgttataatatttaaaaatagaatttaggataaataattatgataccgttaaaaaaaataactgttggaacgattgtctgtctctcatttttgggtttaacagcatgctcttcttcaaatactcagcaaacctctacttcaaaatcaaatgtatcacaacataaaaatatcaaagctgaccacgaagaattacgtttgaaatttaataaagtaaagttaggggttaaagcaaataactttaaaggaggcactagtctcgctgaattaaaacaattatttggtggcgaaccaaatgaaaaatttgatacaccagcgggaaatgtcactcttaaaggctatcgttggaatgtcgatgatatctccatcactatacaattattaaacgatagtagcattgttcgttcaattagtaattttaagtttattcgtgatgccaacatcacaacaaaagattataatagtttaaaaaatggcatgtcatacaataaagtaaaagaacttctaggagaacctgatgatatttctcaagcagtttcttcagataaagaggaactacaggctgcatggattagtggcatccagtcgtcagacagtgatccgggaattaaccttacatttgaaaatgataaactcactaacaaacaacagcatggtttaaaataaaaaggcattaacgcctttttattaataccttaattacttattagaaatattttattacacaatggtttaatcttagtaccttaacttagccccttaatggtcatactaactaattatgatactaacttacacagatttcaaactaattcttccttatttgtcaaccctggttttacttatcagaaatgaggagaatcagtttgtgaggcaagattggagataaactaatataaagcctataacataaagctttatggagcatctattatccatcttaagggaatcgaacccctatcccaagaaccggaatcttgtgtgatatccattacactaaagatggtagtacatgttacattatagcatactttatcaacaaaaacaaaaagacttgctaaagcaagtcttttaattattataattcaatatcaccgaataagtcagccatagagaatccagtttgtgtttctggaagctcgtagtcgcgtttttcttgacgacgtggacgacgtggacgtgattgacgtttttcttctttttcaccttctgcttgcgctggacgctcttcaagagctttcattgaaagtgagacacgttctgcatctgaattaacttcaagaactttaacagtaacttcttgtcctgcagataatacgtctttaggattttcaacacgtttgtgtgaaatttgtgaaatgtgtacaagtccatcaatgccaggtaacacttcaacaaaagcaccaaagtcagtcaagcgttttactttaccttcaataacatcaccagcagcaagtttttgttcaacgccatcccatgggccaggtgtagttgctttaagtgaaagtgatacacgaccagcttcttcatcaattgaaagtactttaacttcaacttcttcaccaacagttacaactgatttaggtgaaacattgcgctcatgtgataattcagttacgtgtacaagtccatcaacaccaccaaggtcaatgaaagcaccaaagcttgttaaacgagcaactttaccagttacaactgaacctacttcaatgtttgagaaaacttctttacgtgctgcagctgctgattcttcaacaacttcacgacgtgaaaggatgaagcgattttctgctgcatcaacttctttgattttagcatcaaattcttgtccaacaaatttttcagtattacgtacaaaacgagtatcaatcattgaagctgggatgaaaccacgaagtccttcaaattcaactgaaagtccgcctttaacagcacgtgtacctttaacagtaacaacttcaccttcacgaccaacaagtttgtcccatgctttacgagcttccaagcgttttttagatacaaggaaagttactgtatcagtatctttacctacaacttgacgaagaacaagtacttcaactgtgtcgccagctttaacaaaatcattgatatcagcatcacgatcgttagtcaattcacgaagtgtcaagacaccttcaacaccagtaccatcgataacaacgtttgcttgaccgttatcaactgttaaaacttccgcagtgacaacgtcaccaggattcacttcgctaacactgtttagcaaatcttcaaattcattcattctaaaaaatcctccaacaaaagctagccgagctagcttttgataacaatatattttctcaaggtaacccgcaaggacaacaaatatctctttgacggtgtcaaacaaaagtttgatacctttgactggggtagctggattcgaaccaacgcatgagggagtcaaagtcccttgccttaccgcttggctataccccaaataatggaaagagagggattcgaacccccgaacccgaaggagcggatttacagtccgccgcgtttagcctcttcgctatctttccgtaacaacactgactattctaccacagatgttgttagcacgcaagctttttaaataaatattagcgattaagattatattcttcaataatatttcccatagcttgatctaaatttttatagaatccactcacttgctcacctttaatcacagcaaatttagaatctagctctgcaatttgacctacaattttttttccaataacgagttggtatccatcaaccttagttccattaactgttacttgagcgtctgaaatttgaatttcaattttcttatcttttttactcactattaactccaatatctctttttattgttttttattgtacacaaaatactaaaagcttgcaagagcaagcttttagtatagacttaatctactttataaatccacccttctggtgcttcaacatcaccaaactggatccctactaactcatcatatagtttgcgtgtcgctggaccaacttctgtctcactgtagaagacatggaagtcatctccgttttgaattcctccaattggtgaaataactgcggctgtaccacatgcgccagcttctgtgaatttatctaattcgtcgacaaagacatctccttcaatcgcttccataccaaacctttctttagcaaggtaaagcaatgaatatttagtaattgaaggtaaaattgaaggactcaaaggggtgataaactgattatctttagtaattccaaagaaattagctgctccaacctcttcaattttagtatgtgtcgctggatcaagatagataacatctgaaaattgtttctcatgagcatatttcccaggaagaagactagcagcatagttaccaccaacttttgcagctcctgtaccattcggtgctgctctatcatattctttggaaacaataaagttagttggtgttaaaccacctttaaaataactacctactggcattgcaaataccgtaaaaatatattcttcagcaggtttaactccaataatatctcccacaccaattaataagggacgaatgtataatgttgcccctgtaccatacggtggaacaaactcctcattagcgcgtacaacagatttaaccgctgcaataaatttgtctgtcggaacatgtggcattaaaagacgatctgctgttctttgaagtcgttctgcattttgatctggacgaaataactgaatagagccatctttagttctataagctttcaatccttcaaaagcttgttgcccataatggagagcaggtgaactttctgaaatatgtagcgttgcatcatctgtcaacttgccatcatcccatttcccatctttaaaatgcgaaatgtatcggaatggtaattttctgtaagcaaaacctaaattatcccaatctaaatttactgtcataaggtacctctttctttgggtttctaactattgtacgctattatcattattttttcaatattatttgtaaaattcagataaattaccaaactagtaaaaacacaaatgtgtttttacttaattttaactgagaatacttcttcgtcagaaatcttatcagatacaaaagagccattacttgtacgttcagaaaaactccattgacttaaatcaacatcgtaaacttttcctgttttagacataatctcaagtacgaaagtatctccttcatgattcgatactgaactaaataaatcaaattcaaaagatgaatcctctaaatatacaggtcctgctttaaaaacgcgatgcggtttggatttcaattcacgaagaacttgaagtcctcgattagcacgactagttgtggggataacatcaatggccattcgtttaagacttcctctatgagttaataaatataaacttgtggtgttagctataaatgcagatacgatgtgatcacgatcttttaaattcatcgcttttacacctgcggctttactaccgacgactggtacatcatttatactaaatctcaacgcataaccattataagtgacaagtataacatcctctaattggataggggcaacagtcacaacataatcctctacactttttaacttagcatatttagctgtttttgacttatatgtccgccatggactgatttcttgacgttcaaaacgctttatttgccctaagctagtgacagcaaaataagtttctttagtaaaatcatctactaattcagcataaataatttcttcatttgaagcaaagttaacaagattttgtgataaatgttcaccaacgtctttccatcgaatatcagctaattcatgaactggacgataagcaagattaccaaggttagtaaacatcaataaatgttgggtagtctttgcattgctcacaaatatcaattcgtcatcttctcgcttaccaagttcatcaacagttgatgcattgaaagagcgagggctggtgcgttttacatatccgcctctagtaacactgacgtatgtgtcctcttcgataattaaacttgcagtatcgatttcaatagtttcagctaattcttgaagttcagaacgtctagtattggcaaatttctttttgacctcacgtaactcacgtttcattacgttatacatcgtacgttcatcactaataattgccttaagcattgtgatttgttgacgaagttcttcttcttcttctctcaacgtcacaatatcagtatttgtgagacgatataattgcaatgtgacgatagcctctgcttgagcttctgaaaactcatagctgaccttcaaattctctttcgcatcagctttattctcagaagcacgaattaatgcaatcacttcatccaaaatagaaagaaccctaatcagtccctcaacaatatggagacgtttttcggctttttctttatcaaattttgaacgagcaataataatttctcttcggtgagcgatatagctagttaatattcttgatagacccacctgcttaggggtgtagtcatcaatagcaaccatattgaaattataattaacttgtaggtctgtatatttaaaaagataatttaagacaattgtttcatcggcttcttttttgagctcaatagcgatacgaagaccatctctatcagactcatcacgcacctctgctattcctggaactttattattaacacgaacatcatcgattcgttttactaaaactgacttattaacttcataaggaatttcagtaacaataatttgtttcttaccaccttttaaggtttcaatagcagttcgcgagcgaaccgctactctccccttaccagtctcatatgccttacgaatttcatcttttccttgaatgatagcgccagttggaaaatctggaccaggtagaaattccattaatttatctaatttagctttagggtgatcaatcatgtacacgacagcatcaatgacttctgctagattatgtggtggaatatctgtcgcatagcctgcagatattcctgttgctccgttgactaaaagattgggaaaggcagctggtaaaacagttggttctttctctgtatcatcaaaattccacgcaaagggtacggtattcttatcaatatcttgaagaagataaccagcaatttctgatagacgggcttccgtataacgcatagccgccgcaggatctccatccatagaaccattatttccgtgcatttcaatcaatgtctcacgatttttccaatcttgagacatacgaaccatcgcgtcatagatagaggaatccccatgaggatggaaattccccataacattaccgactgattttgcagatttgcgaaatcccttttcaaaagtattaccatctttattcattgaataaaggattcgacgttgaacaggttttaagccatcacgaatatccggcaacgcccgttcttgaatgatatacttagaatagcgcccaaaacgctctcccataatgtcctcaagggacatattttgaatattagacatatttttaattttctcctagttggagtggcttagtattatttttccacttatttgaaatgaatgattggctctcttgtctaacgcatacaatattacttgtacactataaaacatgaataaccaaggctctttattaaaatactgtattctcttctaaagtaaacttgacattatcttcaatccattggcgtcttggaggaactttatcacccatcaagacattaactcgacgttctgctcttgctaaatcttcaattgttacacgaattaatgtccttgtctcagggttcatagtggtttcccacaattgatcggcattcatttccccaagccctttatatcgttgtaatagtgagcctttaccaaatttttgtcgtaattcttctaactctatatccgtccaagcatactcaacaatttctttcttaccttttccttttgacattttatacaaaggtggcaaagcaatatagacatgtccctcttcaacaagaggtctcatatagcgataaaagaaagttaataatagtgtctgaatatgagctccgtcagtatcagcatcggtcataatgataattttatcataattaatatcgtcaagattaaaatcaggaccaacacctgcaccaatggtatggatcattgtattaatttcttcgttttttataatatcagccatctttgccttagctgtattcaatacttttcctcgcaacggtaaaatagcttgaaactttctatcacgaccttgcttagcagagccacctgcagagtctccttcgactaaatagagttcatttttcttagcattttttgattgtgcaggggttaattttccagaaagtagacctttatcttttttcgactttttcccattcctactttcatcacgtgctttacgtgcagcttcacgcgcatcacgtgcttttattgccttacggattaaattagatgctaaatctccattttccataagaaagtaagttaacttttcagaaacaataccatcaacaattggtcgtgctaagggacttcctagtttatctttagtttgaccttcaaattgcaagtgctcctcaggtacaagaatagataaaatggctgatagcccctcacgataatcagaaccttcaaggtttttatctttttctttaagaagtcctgttttacgtgcatagtcattcatagactttgtaatagctgatttcaagccagtttcatgtgttccaccatctttagtacgaacattattgacaaaagaaaggatattatctgaaaaaccatcattatactgcaaagcaacttcgatatgaaattcttgttcttcaccttcgaaaaacatgattggtgtcaacgtttctttatcttcatttaaatactctacaaaatcttgaacaccgttttcataatgaaattctagatgctctgcttcttctgaacgattatctgttaaggttaaagtaacattttttaagagaaaagcagattcctttaagcgctctgcaattgtattaaacttaaaatctatcgttgaaaatactgattgatctggcataaagctgacagaagttccagattttgattttggtgccgtgccaatttttttcagagttgtaacgggcttaccaccattttcaaaacgttgtctgtaaatagctccgtcgcgaatgatttcaacttctaaccaagaagacaaagcattaactacagatgatccaacaccatggagaccacctgatgttttataaccaccttgtccaaattttccacctgcatgaagcaccgtgaagatgacttcaacagtaggttttcccatagcatgcattccagttggcataccgcgtccatggtctgtaacagttatactcccatctttgttaataataacatcaatgcgatttccaaaacctgatagagcttcatcaactgcattatctacaatttcccacactaaatgatgtaaaccagttccatctgtggaaccgatatacatccctggacgcttacgaacagcatctaatccttctaagacttgaatagcatcgtcgccataattcgtcactgttatatcttgtttagccaaagtgacctccaaattttttcatcttttttatattacaagttttttgctgtttttgcaaaattatttttttaaaaatagcaaaaagacttttatgcttatgttataataagggtatgaatattataattatgattatcattgcctatctgttaggctctatccaaactggactttggattggtaaatatttttaccaagtcaatcttcgtcaacacggtagtggtaatactggcaccacgaataccttccgtattttaggtgtaaaagctggcattgtcactttgactattgacattttaaaagggactctagcaacacttattcctatcatattaggtataacgacagtatctccattttttatcggtttttttgctattataggtcacactttccctatttttgcacaattcaaaggtgggaaagccgttgctacaagcgctggggttttgctaggatttgcaccttcttttttcctttacttattagttatctttttattaacgctttatctttttagcatgatttccctatccagtattacagtagctgttgtaggtattcttagtgtcttaatttttccattagtaggctttatattaacggactacgactggatatttaccactgtggttatcttaatggccctaacgattattatccgacatcaggataatatcaaacgtattcgaaaaaggcaagaaaatttggttccgtttggcttaaacctaagtaaacaaaaaaataaataataaaaaaccgctagtagcggttttttattataaaactaacaatgtttcgagagtagatttcccttctaatttaaccaatcaatctcatttattccttcttcttctaagaaatgatttgttctagaaaaaggtctgctaccaaagaagccacgataagcagataagggactcggatgaggactctcaataatatgatgaataggattatcaattagcgactttttctttcgagcatagccaccccacagaataaagactactggtgtttccttttggttaaccactttgatgacagcatcagtaaaaggttcccatataagcccagcatgaccattagcttggtgttctggaactgttaaacaagcatttaatagcagcactccttgttgcgcccatgatgttaagtcatgatgtgaacgtgacccgatatcttctgctaattcttttagaatattttgaagtgaaggaggagctggtaaattgtctggaacagaaaatgagagtccttgagcttgttgaggtccatggtaaggatcttggccaataatcactacttttacgttttctagtggtgttatctgtatggcattgaacaccttatctcttggaggataaacgattccgctttcgtaaactgcatccataaatgtattaattttattgtagtaatgattgggtagttctctttttattaaatcatgccaactagaatgtttcatttataactccttacttttagatatctgtattactagtatagcaatattttataaaaaacgttactgctttattcattcaaagcagtaacgtttttttattaatcttcgtccttaagacctagagccaaatcagataaggacactggtctagaattttcttctttcaaagaagtatttataatgtttaaagaagtataaacatcaataaggattccaaatacatgtgcacgttcatcacctaaaattgcttgaaaaaccgtctgtgattgacagaattctaaaagattatctaagcccttaatccattcttctacaatagccagagccttattcataactttaaatgacgattcatcataccaataaatagaacgaatcagttttttttgcttactcaaagcttctattttagaaagtatctcacctagttcattctgcacaatagcaatagaaaaatgtttccccagtaaagatggggttttttctactaatataatttcatcacgaaacaaggttaaataatgaatactgactaacaatttttgaattagcgcttggtgatcgtgtgtttcagtttctctcatactcaaccatccttactatttctgactggtaaaactatacgtagcttactttaaatataccatatcactattgaaatcgcaaaaataagatgaataattttataaaataaatattataaggttttaacttcgtctacaaataattgatattgactttgtaacaaatcattagcctcttgagtaaaatgcaatccatcactagttaaatgataatttagattaccatcctttgataaaaatctattaatatctaacagtggaatctgattttgataacaaaattctgttagccattgattgattttctcaatatctgcattattgacagtttctctaaaaagggtgtaagcaatagttgtcaatctcatctttattttattctcagctaataatgagtagagtttttggaaattgctgaatatttcttccacactataacctgtaatgagatcatttacccctatagaaacaaaagcctctgttacattagctgtcaaaaagttaggtaagttttccaacatcgttgctaatgttacaccaccttgggaataattatggtaactttctagtgaggtagatatcgtttttgaatcacctaaaattatctttgaagcttctctattgaacaaacgactatagccttctttataaaaaactttattctctttttccctaatggcataatcgaaaaagaggtgaccgatgacgtggataaaatcatctctcgtatcaacatctaatgaaaattcctttgccatttgataagcatatgtcctagaggtgaaaaagcttttttcccttaagtaagtttctttattagaaataaaaatagcgccgttcggatagtataaaggttgtaaatcttggcgacgataacctttatctgctcccaccatatctatagcatagccttcatcagataatgttgtaaacagactagggtgtttctcaacttcagaaaaacttacaacattgtcaacatcatgtgaagaataatactccattgcttcctttatatgccatgattttcttagtggagaagttacttgaagtaacacaaactcctgattatcttcatagtcagataaaaaatcttttaacatatcatacgaagttgcctgatcagttgaaagttccggttttctcatcaccactgaaataccgcgttctaaacaaatctctctgtacaattctgaatctgtactaacaaaaatatctttcttatcaaacattccagattcaattgcagcatctatagtatggaaaatcatgggtttaccagataggaataacatattcttatctggtaatccttttgaccctgatcgcgcaggaataatacaaattggcttcataacatatcctttattttatttttttggctggaacccctacataggttccaggttctataatatcttttacaacaacagctcctgctccaattgtcgtacatgatgaaatatccaaggtttgaataataacactggcactacctacataaacttcttctctaatataacaaagaccatttatggtagcattaggtgctatattacagtgtgattctacaacagtatgatgttcaatgagcgctcctgtattaacaacattgttatcaaacagcttcactttagaacctataaaagccccaaaaccaataaagataccacgtccacaaatactatctggtgtcaatactaaagcattgggactaatgatgttaataataaagtcataataatcctttgctacatattcaaatagttctttccttttagcattatcacctattgtaataaatactgcatctattgagccatcttcaaggtaaggtagcacatcataaagttttccaagaacaggataaccatcatgctccgtaatatctttatcatcaaaaaaacctacgaaatcatacacaagaggatcaataaccggagcaatcgcatcagcatgacttcctgcgcctaaaaatgccaacttttttttcattttagattattctcctttaaatcataaaatggttgggaaattgaaggttcatctttcaaatacagctttattgcttcatatgcaatagatgaagcattctctttgtagtagggattgtcaaagttggtcacttcattcaattttgataatccctccaatacagaggaggtttcgactggtacacttactacactttctccatgtagcctacctttttggcgatcaccaatattaagagtaggtttcatcaaagaaggaacttctattaaaccagaagacgaattaccaatcagtcctagtgaatgacgaattaaggaatgataaagttgggttgataaagaagcaaagcaatgactattttcatgatttgtcaaataagtattgatagcctttgcaatatcatcagaaccagtatctgaattggatcctataaatagacactggacaccaaacttagaaagggctgatagtaccgctttcatctgctctccagcactttttccttgttcaaaagtaacaggatgatagagaacaacaaaataggattcctctagtgcaatacctaattgcttttctattgcttctttggttagagaagggattgatagagcattttccactccgagagctcctgtgttaattacaaattgaggttgttctcccatctgaatcacacgttgacgaaagtcctctgtagagactaagtgtaggtgactcatcttagtaattgcatggcgaatatactcatcaaaattgcctaatgaggtctcccctccatgaaggtggcatactgggacattataaatcaacgctacattcacaactggtaacatttcataacgatcccctaaaatgatgactagatcatagtcttccttgtcaaaaattttggtcaatcctagttgtaaatgcgccattgcagtagatacagttcttctgtcagtatcataaagatgtaagggaactttataagcaatatcaaaaccgtcttcttcaatttgacgataagtatagccgtacttttcttccagatgcattgctgttgcaataatttgtaagttgacttctttatcttttgacaatctttgaatcaatggcttcattattccgtattcagcacgcgatccggttactaaacaaatttttttcatcgtatcccttctatatatagtaattacataatcttagccgtgtaatacatctgttgccgattataattaggtgttattataactcgggcaattgattttcaaagcgtgaatcacgaataacttcatcctcttcgaaatcatcttgcgcttcttgtcccaagatgtcataccagttcataggagaaataccattacctgggcgcttcaccgtaatattttctattgaataaatatcgccttttttaattggttttaaagcaacgactgatttacgagcaacaatcttatttttttcttctactggatctgggattttttcaaatctacctaaggcttgttcaacaatgcgaacccctttaactaaagcagctaaaatatcaggtgttgcactggctttatgatccggaccttccatattagtatctaaagtaaagtgtttttcaataacttctgcacccattgctgctgctgcgataggtacttctgatccaattgaatgatccgaataacctatcgttaaatctttaaattcatctttcaaagtatgaataacgtttaaatttagagaggggtaaggtgttgggtactctgttgtacaatgtaaaatagaaatgtcggttgtaccattctgacgtaaaatattcaccgcttgatggatctcttccattaccgccatacccgtcgaaagaataactttcttttgttgcttgccaatcttttctaagtaaggtaaattagtgatttctcctgatggaattttgtaaattggcatatctgtagaaattaagaactctaatgactcttcatcaaaaggtgttgaaaaggtctccacaccttttgaaattgcataatcacgcatttctaagtattcttcaaagcttaactctaaacgtttcgtcatctcaagttgactgtctgctgttcctgtagttgctttttgatattcagctttgggagcaaatttagaaataagtttctcagctttaaaagtctgaaatttaacagcatcaacaccacaagacacggcaacatctaccatttttttcgcaagattaatatctccattatgattgcaaccaatctctgcaataatataaaccattatcttctccttctttttttacccaataagtctaaaatgactttttgaaaaacaatgctatatactataagaataattattcctaaactccatctaataacgatattacctaggaacatgttcattaacatagcataactaaatactataccacttaaaataatgtactgcctaactgagacatctgaataatggtatttaactttcgaaacaatatgatgaaaaatcaacaaggctaaataagatattattgtagccatagcagcgccataggctgcataatgaggaattaatacaaggtttagtaaccaatttacaccagcagctaataatgtcccaataggaatccatgtcgtattagcatagaagaattggatatttacaggaaatgtatagagaaagactaaaaaatagctgacaataattaaagaaataaattgaacactactactatacttgtctcctcccattatttgagctaactcaggaaaaacagtcaaataacctaatgttaagaaaactcctaaatagagataacggctaatataagttgaaagttgcagtaatttttcttttctagcatcaaaaaaccatggaatccaagccatattaatactattcaaaacaatctgaataatcattccaagcgaataaccgaaactatacattgcaacttctttagtactatataagcgagctagcataatcctatctaattgatttaataactgatgtcctaacaaatgaaaaatcaaaggaatagacacagtgacaatgaaccgaaaatacttaggattgtaaaaagatttgctatgataataaatataagcaaaggcaactattccagttattatagtaggaacaaaagctccaaaaaccctagataaaaagtcatcggaccaatgaaaaattaaaaatagagatagtgcaacagatgaaactgcattggctaaggatagtattaaattagccaagctcctctgttgttgtataaaatactgaccaaagaaagtcaccacatagttagcgtaactttgacacaccattaataaaaaaatagattcagaaaaaccaactaatggtgcaagaaaacttctaaatagaaaagctatcaaaagtacaataagaaaccatatattacctacagaaaaggcactcccagagtagcttttaaactcttctccatatttgactcgagccgaacttaaagaaccgctcgtctgaagaccaataaacagagtaataattcccatccaagcaacatataaactatattggccataaacttctgttgagatgactcgagtgtagatgggaagtgtgataaaggctaatccttgcaccaataaattcccgagtgtataaataaaaccagattgaagtaatttcttagtattcatttaatatccttcagatctactaaagttatttttttatcaacacaagttaaaaaatccagcgcggtggacgaatgtgttatcccaaattcgaaccgtcctgttaacatcaactctataatttccatagggatatttgatggtaatagctctaccggcaatttggaataatctactacatctctaggatgaacttttaaataaacattgtaccctaacgttctatattcctggacaatatcgtcaaaataatcgtattgctcttgaatactttgaaacctctctgtaggtgttttataacatttatcttgtgcaagtggctgtgtcaacaataatactgactttggagttatagttaatggttttgttttaaatattttgaaaatcagtgatttttgctctttgttaagactatcaaataatttttttctcggtagttctttatatttcttactccttatgtcatgaggtagccccactaaagaattaacctcaattgagagacaatattttgaaaaaccatacggaacatactttttaaataagtaagttttaattactcgttttacgacagaaccacccaagaataacttggcttgaaaacagttataaccatcttcaattagatgataatttttacccaaatacaccatatagcgacctattaaagtatcatcattaaatagatagacttgtgtatctactctctcaaagtagtgatttaagtctgaatctacaagctccatcacttcttcaatatttttactttgtaactgctcccgataagcaaactctttaactgcttccgtccttattccctgttcatttaatgtttttacccaagtttcataattcgtgatagtgtcacaaataaatattctagtattttctttatcttttaactttattatagtaatcagtaaatggtataaagtatgacacacaaaattattcatttatttatctttttctttcttttacaatttaatattttaaaatgcactacacaatactttaaataatactttatttttagtagcatacgttgtttttttataaaatcaaaaatagtttttttatattcagttttcagagtatgaaattccttataaaaattatttttatataactctatcaaatttacttccatagttttaattaaagctctctcactttgaaatactaagtctggatacttttctaataaataaattctttccttaagtgcttctacagcatgtagccttttaatattgtaggaaccagtcattatgctattttctctaatacgatatgcataagtattatatctaaagaaaattatatttttggctttcaaatataatttataggttaaaaattcatcttcgtgtaacttccctactggatagcacagcgtagaaaataattctctcttatataatttattatgtgctacagtaaaaatagctctataggcatcataattataaatattttgtattgcttgtactggactaatagtttctatcatttcatcttctaaaacgatatttataatatgttgttctcttttttcaacataacaccctaaaacaatttctgaattatatttctcgctaaattcaaccattctctcgattgcatcttctttatatagataatcatccgaatcaagtaaataaatataatcgccagtagctctactaattccataattacgagcatctgataaaccaccattatttttgtgaaaaacgaatatacgcccatctatttctgaataataatcacagatatccccggaattatctgtagagccatcgttaactagaataatttctaaatttgaataagtttgagctaaaacactttctatacactcgtttaggaaagattgaacgttataaactgggataatgatactaactttatccattccttgataacctcaaattatatatttttcttacaatagtgaaatatcttatagaggaaataaataatatatatttaaccttctccttcacactaatcctattattaaagagaatagtcttaaaatattttctatatttttttctgtaataatcaactgtatcatataatttaaaatcaatcatcttcccacatatatctattccaccaaatacttcattatatattacagcagagattaaagatgtattatgtggaaaatttagatttataaatacaatattattttgaattgcctcaaaaaaatacaacattctctcattgaattttgtcctagtagtactattatcgctaaaatacaccactgcagtgacaatatcacaaactgctatttttgaagcgcaagatataagcttaaaagttgtatccatatcttcatgaatttttccttctggatatggattactcaataaattacttctcggatataattttgctaacggggaaactccataagttttcccataatacatttcttccaacgccacctctaaagtataaagtttaatctcttttaaatactgtgaattaatactagtattgtaagtattgttgaagttaccaatactagttaaaacaatatcggcattggtagctttctgtatgttgtacataacctcaattgaataaggaagataaacatcatcactgtctaaaaaagcaatccaatctcctgtacacctaagtactccgttgttacgtgcaactgattggcctctgttttcttgatagaaatattttattcgcctgtcttccaaaaaatacttttcgcaaatatcccctgtgcgatcactagagccatcatcaattatgataatctctaaattctgataagtttgctcaagaatactatctagacatctcccaatatatatttctccattatatacaggcactattattgaaattaattccattctttactcgctctttttaaaccttgctaccttccaaagatagctaaaacccaacaaaattttccacccagcctcttcactctttagtgtaggtattacccctaaagtagtcattttcaaagcctgtatgttcatttttatctttatagctgaccaccagcgatcaaatatattaggaaaagacattacatacatatatgaattttctaatgaaaaaatagtccctttgaaattttttctccataatttaaaaatattagaagtcaaaccatcttctaagtagtcaaaacaatagattttcctattttggggacaaaagtatcccttttttgataaatatatatacattatttcttctgataagaaattctccccttcgaaacaaggaaattcgaaatctactaaataagcattattaataacaatacaagtttcaatttttaagtgatatttatattttaaatcaggaatattaacttctaatattttgggattcaaccaattattaccttggtttaatgaatatcgaggataaacaaggcctacatatctattagacaacgttaggctctctaaatctttaaaaataatttcaactgcatcttctaataaccaatcatcactatctacacatacatgataatcacttggttgcatatatctcattgctagattataggctgaatgcttaccgccattacgtttatacagatatacaatactaactttattctcttttatataattacttacaatttccttagtactgtcctcagaaccatcatcaacaatcaaccatataaaatttttatttgtctgattacatagagaatcatacagataggataatcggtagcctctgttaaatgtaggagtaaaaatatataacatttcgtcctttctattacaataataactatttctttaactttagaaaccttagaagcattctataagtaccatatccaaataaaaaatcaattatgagccttactctaatctttagagaatctgaaataaatgaagaacttttccaacttccttcgtaatgatgtatagaataggtaacactagtcagacaatcaaccttacctgttaataaattctttggattaaaataatttctcggatatattgttatatcatcaatcttttgaataatattcttattcttaagccctctgtttatcaataaattagttgtaacctctacacatgtcttattaagagaagttaaatcacttttgtcatatatagacatatttgattttaaaaagtgatgtcctttaacagcgccaattattaatcctgtattcacatcacaactaatctcccttgctagaaaacactcatgaatcctcaaaggatctaaactttttaaaagctccacatcagtatctagatagaaccccccataagtataaataatatccaatcttgcatagtcagaaacataagcaaaattcttcttagtatatgcttctctcataaaaacatttttactaacatcataattatgctcattccattcaataatttcataatccggacattgttctctccaagtttttatatatttctttaaattatctggtaagggatttcctccaaaccaacaataatgtataactttaggtatcattttccttccttacctcctgccatatcagagcaaatatgtcatatattattcacaatagtaaattccttttttataggttcgataccatcacaaaatattttaccaaaaactagccaactaatattcattaccacactgggataaaaactttcagtaaataatattatagacattataaataggagtagttgaagttcaattatgattatctttttactatagatataatagattatcatacaaaacatggtaagtactacaccatacatactcaataacatagagtagctattatcaaataggacacttgtttccttaaaactatttccaaaaggagttaaaccatctacaagttgtaaatgagcatagtgtaatctacctgttaaaagaacatctaatttttgaacaaaatttgaattaaaaaaaattgtagaactcaaaaaggtaaatactaataaaaaaaattgtacatagggtgctaatttcataaatactctttttattaagctattctttgtcacataaatgagtacaataaataaaattacgatataataccctgtccttgaaaaagtatattggtacaataaataatttaatgttaaaaataaaaccatcacaacaggctttagtcgtttataattgagtacaatatacaagaaaatagttagagcaaaaaaattatgaataaagttaggatgaccaaaacctaagtcacttctcagaataaattgtccatccctataaaaattgacatacttaatttctattaaatctaatttcacaaaaatttgatttaatagaactcccaaaatacgcgatcctattattatagagaaagctttttttagagagatgtcctttaatgctagaaaaaaaattaaagttaatataaaagtaaccttatgaacaaagaataaattcaaaatggtcgcgataaataataaaaagatgatcacgagttttcttctttcaaaataaaggctatctaataaaaattttattccacacagtaaaattgcaactaacatcactattttgtaagctgagtttccctcgcctaaacccagtgatttaaaaaaattaactaaaaatattgcaatataaaataaagagtttttattgattttcatcgcacaactcctttaatattaccttaaattcttcaataaaattactactattagtttctaaaaacggacgattcatcattccctcatagactacattttgtaacctttcaatatctacaacgatatcaaaattatacattgtttttaccttattaacaaagtccacctgatgattattcacatgctctccaaactgttcttgtctaggaaccacaatagttttttttcctttagaaactgcattcataaacgtcgctgggccgccatgtgtgataacaatctcagcttctttcatgtaagagttcatatcatcatatgagagaaattttgaccactgacaattctgaggttcaaagtctgagtaacccgtttgaatgaacacttcttgatcaatagcacctgtcccttttaatctatcaacttctttaataagacggttgaactgctgttcatgtgtccccactgtgacaaaaatcattaaaaaattcctcctaaattaattgccttaggataaacttttttcatttcttcccactgaacaataaatttatctgttacaggatacactaattttcctgtcaaagttggtttatccatcctgtcgaaaacctctatgtaaacggtcttacaaccaaataacttaccaatataaaagaatggtactgctacagcggcaccagatgatatgataacatctggtctttcttttctaaggaccttaaaagctagaatagtattttttaccaagtttttgacattacggtttgttggaaagaagcaatgatatacaatctcttctcttagaatactcctagcatcttctttatcaaaggttacccaaaacctatcttctttttcccaaatgggtttcaaaaggttcaagtgtgctagatgaccaccacttgaaccaaccagacaaattttcattatattcctttcaaaccttacctttacttagctcctgtcccgagtaaaactacctttagtgttaggagaataatcttaatatctgaccaaatagaccattcattgatatattgaacatctaactttacgatttcatcaaaatcagtaatattatttctaccagatatttgccacaaaccagtgattcctggcttaaaactaaggcgtcgcttctgcgttgaattatacttttcatattcatcaactgtgggagggcgtgttcctactaaactcatatcaccctttaaaacattatagaattgaggcaactcatctatgcttgtttttcgaataaattttcctattttagtaattctaggatcatcgtctaacttaaacattagccctgtcatttgattgtgaactaataaatctttcttaatttgttctgcatctactcgcattgatctgaatttatagaatctaaaaatcctaccattacgacctactctattttgagaaaagatagccggtccaccatcttttctgatttgtggaactagaaaaattgccacaatgccacatatgagcaaacctataatagcacccgtgatatccaaaaatcgttttgctataaggtgactatatttatagaatttcatagaatatgtaataacactatatccttcaaaagtttggattcgcttttctcctatattatcaaagctaagtgcctctacattaacattgacaatcactcccattgcttcaatgtcattaataatatcttgtatttggtatttaccaaataattcaatgggtatgttaataaaagcttgatcaacagttaagcaggttaactctgaagtaagagcatctttgtttattatccttaacgagttatgtttcaaatcataacaatccttttcagaggaatccaagatacagacagcgatataattatggtcgtatttattcctaaaggtcatttttgataaagaatccttattcgttatcaaaacaactttggtatctcgtgaaaacttagcgtaagaatattttcgataatattttaaaaatgaattcaatagatataataaaatcgaattcatagcaataaaagtaaaaaaggaaagtcgtgtcgttgtaaaagagtttttaaaaataaaaaataatgaacttgatatgaaaatatagtaaaagctgtatttcaataccattttaaactcttcaagatagccacgactccaaaagtctctgtaaaaatcagaaagataaaagacaatataatgtatcaatagaacaaacaataaatctttattgcttttaaaattgggagtaattaatgttaatgtcaaacttgcagaaaaataaaccacaactgtttgaatcatcgctataataatcttttgtatattttctttttctttcaatacaagagccccttacttcctttttctatccctttttccgtaatttccataatcgccgtaagtagcaacagattcattaactttattaagaataatacctaagaactttgaaccactttgttccatctgttcttttgctttttcaacataattacgttttattctgcctgcttgggttactaaaataaaaccatcgcaagcattagcgattattgcggcatcaacaactaaaccaataggtggagtatcgatgataatataatcaaatatatttttaatagcttcaatcatcttattaaaataagcgttctgaagtaatgctgttggatttggtggtactttccctgaaggaacgaccatcagtctaggaacattggtttcacagataatatctccaagatctgcattacctgataaataattcgtcaagcctttaatagttccagttgctttaaaggttccagacataacagagttcctagtatccgcatcaattaataatgttttaaatcctgcttgagctaaagataaagctaaacttgttgaagcagtggattttccttccccttccctaacagaggtaattgcaagaattttattttcctttccactaaactgtatgtttgtacggatcgcattgaagtattcttctgttttttttgcttgtcttaacttgctatcaactatttctaaacgagtcattatattctccttaaagtttattcaaatctggtactatacctaaagaagtaagtcctaggaccttttcaatatcttcttcagtattaacacgatcatccaaaatacccataataactaaaacaatagttgataatcctgcaccaacaataaacccgattagtacattctttttaatattaggagaagatggtgctttaggtaaatttcccttctcaagagtagtgatatcctctacttgagtaactgccttgatttttgaaactgctgcttctctaactgaatttgctaatttttgagacatttttggattagcatcttcgaccgatattgaaataacacgtgtatcttttaaaatagaaactgttattttttgcaacaactgagacgaaggataattcaatttttcagaagaaataactttttctagaacgtcagtagacgtaataatctccttatagtcatttgcaagaaaactccccgcttgtagatcttgtgcagtaatactattattaggggtattagggttaatgacatatatccttgttgaagaagtatattgtggcgtaacaataaaaagactatagaaaagtccagctgttgcaaatgcaatggcaacaaatgtgattaaaaatttctttttccacaatttttttaaaaggttgaatatatttatttcaacttctgtattagctattttattcatgaaatctcctaaatgtaatggttttttaatatagattgagcattttcaataaaaagttggttagcacgttctttaccgaaatctctacagataatcttataagcttctgctaaaaatggcggtctaacatcaaggttatgcatatcactcgctacaaaatgcactaaattttcctctaaaaaataacgggctcttttcttaaagcgtttatgcttatcattaaaaagtttttgtttcaaaatatgggaactatttatttgtgtgtaacaccccatattaataatttccttcacccgttctttttgattctctaaagcgttatacctctctatatgcgcaacgactggtgtaataccaagcattaaaacatttgacaaagctgtatgaatatctttccaagaagtttgcatagaaaattcaattaaagcaaatttcgtattgtttaaagttggaatttgctttaacttcagtttttctaacatatcacttgtatagtacaattctccaccatataagatttgaagatgttcaaatcttttttccgcttcgtgtttaactatagaaaagtttttgaagataatatcttcaggtgtttcaaacataccttttcttctatgtgatgtcgaaacaattattctaacaccttgtcgataactttcttctattaaagataaactctcttcaagcgttttaggcccatcatctacatcaaaaacgatatgagaatgaatatcaatcattcttgttattcctccattgtgttcttaatttttgattttgcattagataagctagattgatcaattgacatcatataaagttgagctcctggcattgcatatgaagggagttcacccgttgaaccatgaccagttaatgcttgtgactcgacagtgaagcgttgtccagttgacaattgattgttaatcaaatcattaatgttatcaatagtcatattagtttgaacggacgtttggagctgtgaggtaatgctatttaattttgttactgactgactagaagctaacttatttataatagctgcaatcactttttcttgatttctacctctatcgttatcgcctccttgtagagaataacgttctctaacaaagcccaaagcctgctcagaattcaatgttacttgaccaacagggaagtcaaaattaccatgtttacttgtaaaagcttgatcgttataaactgtcactcctcccaagaggtctattaattttaaaaatgatgaaaaattaattctagcataataatcaaggttgatgtcgtaaaggttttcaagtgttttcattgatgtctcaacgccatacaaacctgcatgggttaatttatcatattgattgcccccaccatctggaatttttacataggcatctcgtggtgttgtcgttaacaatactttgtgggtattggtattaaccgtcataataatatttacatcagatcttgatactgttgatatagagccaaaagtatcaataccgctaatatagatattaaataccccttctttatgattagtatttttacgattaatttttttcttaattttgtaagtataaatcgtttttatctgcgatttaaaatcaggggtgctaagttcaattaagctaacataagcattatttaaaaccatagcctgactatcaccacttttaattctattgtatgcatcctggtaagaatctgttttttgtggtgtaatagagattcctttttctgattttatatgttctatcaaatcagtaatatttgaagtatcgtttttaactggtgcggctaatttgctgacagcttctatattggttattttagaatcttttggtacaactacactcatctcaatttcagagtatgaagcagttttatttagattatttgtcaaatcaatggttgacttaaatccatataaagtagtagcaacgaaaatagaagctaatactaaaattatagttgtaaaaattctagctttattcttaatacaaagaaataaacttactaaaatgattaaaacaattacaactccataaatgacgttcaggtgtctaaatgccaaaaaatggtgacgatacataagaaataatgagactacacttaacaaaataaaaatcaccaaaagaaataaattaatcacccgtagaggtgtatgtgagtgtttcttttggtgacggcgcgaatgattagacattgtaattctccaatacttaaaaaaaccttaattttacttggatattatatcatttttcaatacaatattcaacgaaagtaatatggaataatctgattatattagctaaataacattttcaattgatctatattgataatttagctgatctaattgaatttatttacattctagtttaaactagagttatgagaattcaacaattacaatatgttattaagattgtagaaactggtagcatgaatgaagccgctaaacaactctacattacccaaccttcactttcaaacgctgttaggaaccttgagactgagatgggtatccaaatttttattcgaaatccaaaaggaataacgttaacaaaagatggtatggaatttctgtcatatgcgcgacaaattctagaacaaacagcacttcttgaagagcgttataagggtgataatacaagtcgtgagctgttcagcgtttcttcacaacactatgcatttgtggttaacgcttttgtagctctctttaatggcacagacatgacccaatacgaactttttttacgtgaaactaggacttgggaaattattgatgatgttaaaaatttccgttcagagattggtgttctgtttcttaatagctataatagagatgtattaaccaaattattcgacgataattccttaattgccacaactctttttactactacacctcatattttcgtgagcaaatccaatcccttagctaatagaaaaaaattaaatatgaaagatttagaagattatccttatctgagttatgatcaaggcctgcataattctttctacttttctgaggaaatgatgtctcaaattcctcacccaaaatccattgttgtcagtgatagagcaactctgtttaatttaatgattggattagatggttatacagtggcaactggtatcctcaactcaaaattgaacggtgacgaaattgtcgcaatccctcttgacgtggatgatgttattgatattgtctatatccgacacgacaaagcaaacctttcaaaaatgggacaaaaatttattgactatttattagaggaagtttcgtttaatcataaaaataaacagtcctgagattgtctcagaactgtttttaaattactcaagtatatttataataagcttgttaaccgtatcgtagtgaaaattaacagtatcatactcaacaccaattacctttgccaagaagataatctggtctaaaaatgcttgagaagaaaattgagttgtacgatatagttcttgctcatcaaaaggtttaatcaggtgagccaaaggatttctgactgatttttcgaactgtcttaattgaatgatggtcgatttcacttcttcatcaaggtcggttaattgtaaacattctgccaggcttttagaagtcaagcgactatcgtgccacctttcagagaatgccaaaaggactgggtggtttgactcctttaattctttaaacttccaagtatcgtagtgatcatctcttgcattatggatgtaatcatgcaagtgaggtacttcttgtgcaagtaaaatcataaatagacgatataaaataggactaacactacggacaaaatctatgattaatccgttttttacttttgcttctaaatccatgatgtaatttgccagcaactctaaatcatacgggttatgcaaaagctttatattgtatttttcttgtaatataacaacttgttcttgatgagcaaaaagaaaatcaatgtttaactctcgacgctctttcatcatttccaataaaaataataaatctgagtttaaaggaccatgtttttgtaataataagaaagcattatgataagaatactgatccactaatactttaagagcagttgaaaaatctgtcatttctatcctcattcagaaataagtgtttcgagcccaactttcatcatatcagtaaatgttgtttgacgctcttctgcacttgtatcttcttctggattattcaagttatctgaaatcgtcatcatagcaagagcattaacattgtgttgagctgcaagatagtagagagctgctgcttccatctcaatagcatgaacacctagtttacccaaggccatattacgatctggttggtttgaataaaacacgtctgaagataatacactgcctacatgagttgtaatatccatttcctttgcgatgtgataagctttatccaaaagtttaaaatcagcaatttgcggaaaatcaaattcaggccaatcattacggataatattagaatttgttgctgctgcttgtgccaaaacaagttcacgaacatggatatcaggattaatagcacctgctgttcctacgcgaatcaatgttttaaccccataatcaacaattagttcgcgagcataaattgaaattgaaggcatacccataccagttcccataacagaaacacgatgtcctttataggtacctgtataaccaaacatattgcgaactgtgttaaaacacaccgcatcttctaaaaaattctcggcaataaatttcgcacggagtggatctcctggaagtaaaattttatctgcaatttcaccttgttttgcttcaatatggattgacatataaactcctcatttttcttataaaataatcataggcagtagcaaaaagtactgctatagttaggggaacaatagttataacagattgaccagtaaaagatatgactaaaccgacagctgtcagtggcgctctcattgtaatagctaaaaaaatagctgcaccaaccaacatactggttactatcgatatgtggggaagtaaaggaatagaaatactagctaacaaaaaacctaaacaagcaccaatggaaaaagatggtgtcagtataccgccataagcaccagcgtaaagagtggataatgttgctatcatcttgagaacaactaaaatagcgattaagctaactgtggtccctttaaagacttcttgaactagggcattaccatttcctaaaatctggggatagacgattgataaaacagatactatcaatgacactactggcaaacttaacaatatttttatatttttaatacgtctctctgtcactttttgatttaaatatctaaagctaatcgcaatcggagttacacataaaacgatcaagaacataaaagctaatgactgtgaattcagactcatctttgaaatatgataaagaggggctgtcgaaataactaattgagcaatactagctgcaccaaaagtagaggctagcaatgtcacaatatttttcagtgagattcctaaagctaaagtttcaaaagcaaagaatacactagctagggggacttgataaactgctgacaaacctgcagctgcaccactaatgattaataaacgtttatccagcactttaagtgctaataaatccgatattttcccagcatttatggctccaaactctcgtggcgctccttcttttccaatagggccaccagttcctacataaatcaattgcaaaaatgcgtgacctatatgtagccagtaaggtgatttttttacagaaaaatccttaaaaacaacctgttgtttaatactagttatttgctttggtttgatttgtaagtaataccaactaagggatgctaaaaaggagactaaagtaagtgataacactcttttaattggtgtgacactatttaacaaagacagagtattttctctactatcaccaaatgctaaccactctgtaaacattaatacatagtgcattaagatagctccaactcctgccataactgtcataaatagaacggctatcataaacttgacagcatagtataatcgagaaaccattttaaagttcagcaactaatgatttaactaatcccttgaaatcttctttaatacgctgagtaacttcaacgacctcctcatgattgagctcagattggaagccagcggcaaagttagtaattgctgaaattcctaacactttaagccctgagtgagctgcaacgatcacctctggaaccgtggacatacctaccgcctgtgcgcccattgtttggaatgcacgaatttctgcaggtgtttcataagtgggtcctgatacacccaagtacacaccttcttcgagtttgatattctgtttttcagcaatttggtgagctttttgtcgatatgttgctgtataagcatccgacatgtctgggaaacgtggtccaaattcttcaaggttctcacctatgagagggttagtcccaatcatattgatgtggtctttgatcagcattaaagttcctggtccgtatccaatcccacccgctgcattagtcacaagcacactgtggcaagccaatgctctcatgatacgtactgggaaagtaacgacttccattgtatttccttcataaaagtgaaaacgaccttgaagtgctaataccttacggcctgataaatccccatacactaattttccagcatgaccaactactgttgactgtccccaatttgggatgtctgcataatccacaacaatgggattttcgatttcttcagctaattctcctaaaccagagcctaaaataaggccaaattctggtgctgtgacgccttttgcttgcaaaaagtctctagtctcattaattttttctaataatgtcatttacttacctcctaaaccattattcactatacaatatgctataaactttggataatctgtccatcttctttaacaaaatctttttccatctttacaggtaaaatggttaaaattgcttcacagggtcggcagagttttgcacctttactcgtaacaactatgggacgattgataagaataggatcttgtatcatcgcatcaatcatttcttcatctgtaacgctagaagattccaaattgaatttctcataagcaggaacatctgttcttagaagttccctcgcagaaagtttcatttctaacaacagttcaaccagttccatcctgctaggtggtgttttcagataataaataatttctggttcaataccacaatgacgaataatggcaagtacgttccttgatgtcccacaatttgggttatggtaaatcctaattttttccatcatcttcctctcaatttttaatgctacaagtgtcttaaggaaataaaaatttataccaagtcctgcaagaagctctctccaatcatcgcagtatcaacaccaaagttatccgcaactgttgctgaaatatctgcgaaatgccctactgggataaggccgtttcctgtgaaagatgggctataggctaagagaggaatgtattctcttgtatggtctgtacctgcataagttgggtcattaccatgatcggcagtgatcaaaagtaagtctttgtcacgcatcgctgaaatgatctctggaagacgctcatcaaactcatgaagacaatcacgataaccatgaggatcacgacggtgaccatagagagcatcaaagtcaaccaaattagtaaaggagaagcctttttcaaactctgataaccccattgtttttatcaaagtatcaataccatgactatttgatttgttatgtcccatatcatgattaatgcctgaaccattgaaaatatcattgattttaccaacagcataagtatcgatgccagcttgatctagtttatttaatacggtatcttcaaatggtgatactgcatagtcgtgacggttggctgtacgcgtaaagttgcctggttcacctacatatggacgagcgataatacgaccaaggagagctggacgctccattgtgatactacgagcatattcacaaatacggtagagttcttctagaggaatgatatcctcatgagctgcaatttgtaggactggatcagctgaggtatagatgatgagctcaccagtttccatttggcgtggtccgaagtcatcaataacagctgtccctgaataaggtttattcgcttcacgaataactttacgtcctgaaaaatcctcaatctttgtaataatatcttctggaaaaccattccagaaagtatcaaatggctctgtaatatttaagcccatgatctcccaatgccctgtcattgtatctttaccaagtgatacttcttgtaacttcgtcgcgtagccacttggattttcttctgcagggacggtcttaagcgcttggggacgaggaatattaccaagtccgattttagccatgtttggcaccgcaagtccaactgtttttgaaatgtggccaagcgtgtctgaagcaccatcaggaactcctgcattgacaaaatcattggcatctggtgccgctccaatccccactgaatctaagacaactaagtgaatgcgatcaaattgtgacattatatcttctttctaaggaggttacggttagctcctaaaaccgattatttaaataactatttttcaagtatgtcaagaccgtttttgcctgctactataactttattaaccataccattaaataaaccatgttcaacaacaccaactgtatggtcaagttcattcgctaactgctttggatcctctatttttttcaaatctaggtcgataatgtagttccccatatcagtgataaagcggtcaccttctgtttcacggaaagaaggacaataaccttttgatttaaaaacccgaaaaagacgctcagaaccatatctaacaacctcaacaggcaatttaaatgcacctaacgtttcaacaagtttgctctcatcgacaacccagatatattctttagttggagtagctactattttttccatgagcagcgcaccaccgccacccttgataccattaaaatcagggtctacttcatctgctccatccacagtgacatcaatgacatcaatatcatctgctgatttcaacggaatacctaatcctcttgcctgctcagtcgtacggtttgacgttgtaacgcctacgacttgcaatccctcttctttgacacggcgtccaatttcttcaacaaaaaaatatgctgtagaacctgtccctaaacctacaatcataccgtttttaacgtattttgcagcggtcactccagcaagtttttttagttcgtccatattttccccttttaagttaatgttgtctaatatttttgataagtctattcaaaacactatctcaagacacattataccattttttaagtgatttttgaaaacattttctttgttctttatgcattttagttagtagcgatagtcaaattctttatttttaataatctattgctaacgcacttatatcacctaaaataagtattcaaacaaaaaagatgagtttcttagctcatctttttatgcatataagttttttagcgtttgaatatcaacttcttgaatgccataatgcgaaccttttgactgcataacggaatgttgttgatcattatgtcctagacctaacgcatgtcctaattcatgttcggccgtattaacaatcctagtatggtcataaccaaactgtttattcttaaggtaaaatgtgtttaattcaactgttacctttgaaatacgattagttaaagcatttttctcggtttcagctacacccgcagcttgtgttttagcatctgagtaatccttagcaataatatcagcattaggattatctgttgtttgtaacacaaaagcacctgttgcattccaattggagattgcttgcttgtaagcagagaccaactcagaatctctagttgctatatagatagttgcctgatttttatcccatctggtattttctgaatgatgaacattatccgtagctagattagtaaaggaatttttgagctgattagtgtcagcaaaatttaaaaatgtttttcctgtctgaataatgtcactaagttgattagcaaattctgattgactgtgattcgcatagtaatacaagccaaataaaataatcgcaataacaagaactgtcttgaatattccccaaatgatattccaaatcaatctaaagataaactttggaatagcaaatatcattctaaatagtgttctcattttttatctcaccttctgtgtctaatttcccaaaacttaatgatttagtataacaagactttacttggatttcaacgatttagctaatactaagaaaggcgctcttctttgacataatcaacagggagccattctaagactttttctaattgttgattccagtaataccattcatgtttaccatgatcattgaaatagtcaatagttaaacctaattgacgaagttcatcaattgcgacttcattagcttcaaaaagaaaatcttcataaccacaccatgcataaaatttagtcttcatatcaaaagactcaacgtaacgccttagtgaatgacgctctatgttatcagtgttattcaaatcgccaaaaattcccgaccaatagttaatgttattgttgccattattgaataataaatcaaagtcaaaagaaagtgcacctgacaaagaggcagcatgagaaaaacgattagtcagtagagctattttatatgctccatatccccccatagataatccggcaatgaaatttttctctctcttatcagacatattaggaaagaaacgtttcaaaacttttggtaactcgatagctattgcatcaaaataatccaacccatactttgtgttggtataccatgctaagtctgttgatggcatcacgacgataagattagtatgacgtaaaagacgctctatatttgtgcgtttttgccaagaattctcatttccccccattccatggagaagatacaaaacaggaatgtcacaatcatcaattttatcatcagacatctcaaaagcatctgggtaaataacattgacttgacgttccgttcctagtaccttagagtgatattcaatattaaaaaatgccataaaaacctccattctagcaagaaaggctaccaaaatttggtaacctcttaacactatcaacgaacttccataaccacaggaaggattgctgggcgacgtttcgtttggtcaaataagaacttgctgacctcatcacgcactttccctttaagttcaccccagtcaaatgtatctttacttaagtaatcttctaccgttgtattaactaattctgcgctctcacgcaaaatatctctgctttttttcacatacacaaaaccacgcgtattaacacgagctttagaaataattttcttttcttttttgctgacagttataacaacaataaaaattccatcttcagataataccttgcggtcacgaagtacaatattaccaacgtcaccaatagcatttccatcaatcataacatctccagcaggaacagatccactatggaagaagccatctttttcaagaaccatgatgtcaccacgcttcacaatataaatatcatctgctgacattcctacctcttgagctaagcccgcatgtgctgacaaatccctatactctccttgaattgggaaaaggtatttaggtttcaatagattcattaataattgtaattcgcgaccatttgcatgacctgatacgcgcaaattctgtgttatcaatttaactgagccaccagctttataaatcagattttcaacacgcgctacaactgcctcttttgcaatacttggtgttgttacgataaatactaaatcaccatctttaatttgaacataacgatgacgtccgatcgccattttttggagaccatttatcggctctcccatacgtccagtttcaaggattaataattcgttatcttcgtaacgtgtcatatctttaggtttgataatcatattttcatcagcaatatgaatgcgtttcatacgaatggccgtacgaacaatattttcaatatcaaaacccgttaaaactactcgacgaccgttttctgccgctgcatcaaagacttgttgaatacgaatgagattacttgcaactgccgctacgatgactctaccttctgcgtcttcaataacgctcttaatttcatcaccgacctcatattcgctagcaacttgctcattgcttgtagcatttgcagaatctgataaaagtgctaaaacaccatcacgaccaatttcagctaaacgcgccagatctgtttggtaatatttccttgcagcttgatcaaatttaaagtcacctgtgtaaacgatatttccctcttttgtcccaataacaattcccattgactctggaattgaatgagtcgttttaaagaacgaaatcaccgcatcttgaaattcaatttccgtttcactatcaatcacatggaaattattgaatttcttgactgctgtactatttttaacgaataacttagctaattcaattgtgagaggtgagccaaacacaggtgctttgacttcggcgataatataaggcaatgcaccaatagcatccgcatgtccatgggttaagaaaatcccctgaacacgttttttattttcaattaagtaatcaagatttggaataacaacatcaacacccagttgttcattttcaggatatttgagtccagcatccaaaacaaagatagaatcattgacttctactacatataggttttttccgttttcacgaacacctccaagagccatgatttttatgtcgctcataatgagttttctccttaaattttgttaattctttttataaagcagacaagaaattgtccaattattatcattagtaattgatttatcggtaacttttcttgggtttgaagaaaaaccttattaatcaataataggaatatgaattaaagagtgtgtccttattttcatcccatttgtacttacggtccttgtctctacaagtcgatttacagcattattagtatatcatattttgaaaataatttcttgcaaagtgtatagaaaaagaagtgaaacacttccatttcacttctttttaatcaaataattgataatagtcagctatagccatcttgtttttttgtgcctgatttaaatctctgacaatcttgccatctttcattactaatacacgatttccatatttgagagcatcttccatatgatgtgtaatcattaaggcagtcaacgaatcttgtttgataaactcatcagtcaagcccataagcgaaacacttgttctaggatcaagcgctgctgtgtgttcgtccaataataacagatttggttttttcaaagttgccattaataaactaagcgcttgtctttgtccacctgataataaacctgtaggtgtctctaaatggcgatcaagtccattaccagttctagcaatcaatttttgaaattcttccgtatagttaataatctttctaggaactagcggtctcttttcacctcgaaatttagcaactaataaattttcagcaactgtcatcctaggtgctgttcccattttcggatcttgaaatacccgtgataaatatttagctcgtttttctgctgataaattagtaacatcttgtcccatgatgtaaatatttccactgcttaacatcaaggtacctgcaattacattaaaaagcgttgattttccagctccatttccacccaatattgtaatgaagtcatgttcataaatactcaaattaacatgatctaatatcgttttcatttctgctaaaccattactgacttgtacggttgcttcttttaactctatgattttcatcaccattataagcgtactcctttcaaaatcttcgtttttaggacaggaaccattaaacaaattccaagcactattgcactaaataattttaggtaattcgtattaaatcctaaggcgattactgccgttattaaaaattgataaagaatagaacccaccactatagcaattaaacgttcaaagagagttaaaccagtagagtaaagtacctctccaataataatactagctaacccaataacaataacacctataccttttgatacatcagcatatccatcttgttgacttactaaagctcctgataaagcaattaagccatttgatacaattaagccaagcatttccattttgtcggtatcaatgccgaagctctttgccatatcagggttatctcctgttgcaatataagcttgccccaagcgtgtatagagaaaataaattaaggcagaaatcaccaagagaatagctatcaagcctaatacgagaagatttaaatcatttgaaaacggaagaaaatctttcaatgtttgaatctcatttaaacctagatttgctcttttcataaccattagcataatagagtggcatgaggtcattactaaaatccctgctaaaatcgtcggtatctttcctttagtataaagtaaaccagtaacaaatcccgctaacatccctgatagcatgcctagaatcgtcgccaaaataggattaaccccttgattcattaaggtaacacaaaccgctccccctagagggaaggagccctctgttgtcatgtctggaaattttaagattctaaaggttaagtatatccctaatcctaatatcccccataataaaccttgtgaaactgatgaaataatcataaaaccctctttctaatcgtcaaccttaacggtaatttctgcctgtttcataatcttcttaggaattttaattcctaagtgtttggctgctttcaaattgaggcttggcttccctgtatcaataactttgactggtacatctttaaccggcttccctcttaggactttaatggcctgttttgcagtttctaaccctaagccatattgactctgcgctactgatgctatacttccttgttcaaccatggtatcaacactggaatacacaggtatattagcttggtttgctgctacgataactgttctaaaagcactcgcaatagtattatcttgtggaacaaagacagcgtctacttttttggtcatgactgacatacttgtcttaatttcatttgtagatggtacagaatatttaagaacttctagccctgctttttgagcatattttgtaaactcagttacttgtgatacagaattatcttcgctactagcataaagaattcctatacgtttaatattgggagttatatccttgattaattgcacagtttgcttggtcggaacaacgtttgataatcctgtaacattagttgttggtttcttcatattcgttactaacttggcccctaaaggatcagaaacagctcccatgattataggagtgtccttagtcgaagctgctaaaccttgtgctgatggtgtcgcaattccaatcaaaatatcattgtgatgattaactaattgtttactcatcgcttgaattttactttgatcagcttcggcgtttaaaacggttaatttaacttttttccctttatatccttcttgagctagaccatcttcaactcccttttcaatagcatccaaagcatcatgggttacatactgtaaaataccaattttaacaacttgcttttctgataaattaagacgtttttctgatttgttataaaataattctccaaccactaatatagtcaatagaattagcgtagctatcagccctttatttttcatattttctcctcactttaataataccttgactttctggagtttagcgcaaaagaaaaagcgcctgataaataacttaccttgcgctctctattgttagactagaccagcgcatagatacttttttgaagtactccaaaaagtcgtatctatgcacccataaacacaactttatctacgccagttttgccaattggtaaataatgttttagtcatttactagtcatcttttctcatgaatttttctataattatatactatattctgaaaattgcaagccttttgcattataaaaaaatatttttagctcagcctatggtataataaataagctataatttttagaataagggggacgccatgtcttttgatggattttttttacatcacctcacaaatgaattacaagaacagattgaaaaaggacgtatccaaaaagttaaccaaccttttgaccatgaattggtattaacaatacgcaacaatcgtcgcaactataaactactcctatctgctcatcctgtatttggacgtatccaaactaccgaagcaaatttccaaaatcctcaaaatccaaatacttttacaatgatcatgagaaagtatttgcaaggtgcagtgattgaaaccattcaacaaattgaaaatgaccgtatattagaaatcgtcgtgtctaataaaaacgaaatcggtgatcacattaaagcaacacttgttgttgaaatcatgggaaaacacagtaacattatcttgattgataaaaatgaacataaaattattgaatcaattaagcatgttggtttctcacaaaactcctatcgtactatccttcctggttcgacttacattgccccacccaaaacaaaagcaatcaatccttttgatatttctgatcaaaccctatttgagctgcttcaaaccaatgatctaagccctaaaaacctccaacagctcctccaaggtttaggacgcgatactgcgctagaattatctcactgtttgaaagacaataaacttaacgattttcgtcaattcttttcgagagaatattatcccagcctaacagaaaaatccttttccgctgtccaattctcaagcagtcacgaaacatttcagtctcttggacaattgttagattattactaccaagagaaggctgaaaaagatcgcatagcacagcaagctagtgacctcatccaccgtgttcaaagtgagttagagaaaaatatcaaaaaactagctaagcaacaagacgaacttctagctactgaaaatgcagaggagtttcgccaaaaaggagagcttctaactacctatctctctatggtaccaaataatcaagatgtcgttgtgcttgataattattacaccaaccaaaccattgagatttcacttgatcgagctttaacacccaaccaaaatgcccaacgctactttaaaaaatatcaaaaattaaaagaagctgtaaaacatttaaaaggaattatttcagatacggaaaatacaatcacctaccttgaatctgttgaaacatcgctaaatcatgcttctatggaagatatcaatgatattcgtgaagaacttgttgaaactggatttattaagcgacgcgcacatgataaacaacataagcgtaaaaaacctgaacaatatttagcatccgatggcaagactattattatggtgggacgtaataatctccaaaatgacgagttaacatttaaaatggctcgtaaaggggagttgtggtttcatgccaaggatatccccggaagccatgtgttaattcgggataacctcaatccaagtgacgaggttaagacagatgccgccgagttagctgcttattactctaaagctcgtctctccaatcttgttcaagtagacatgattgaagcaaaaaaactcaataaaccaagtggtactaagccaggttttgtaacttacactggtcaaaaaaccttacgagtcactcccacacaagaaaaaatagatagccttaaactaaaaaaatagactgggacatatccctgtctatttttagtgttattaattatttataggtattcttattcacttaaatcaatatcttctctaagcttttgtaggtcaaagttagctttcaaaaattcttgatcttgagttgggaaacattggtcaagttggtcaacctttccaatttcaacttttccttgtgtgagcgagtaatccataacatgcccaccgaaagttaaatcgtctgaaataaagtggacatggaacccttttacccccacaccatgaaataattccggcgtccaaatcccaaccaacgtaccagatacattctctctggtaaattctggctgattagatgcaatatctgcaaaacgtttatgttgtggagattttggaatcatacgaacgtgcattcttgaaaacgttcctttgatttttaaagacttaaagagattttgaccttcaaagttttttagaatcatctcttccaaatccttattatctatctcagcattgatatcaaattgtttttggatatggtgtggtaaaaccgctgcatagggtactgtcacatcatctgataattggataatctctgctttaccatctgtaccaatagcttgataagctttcccatccaatacaatcaattcaccatcaatcatatgaacagtaccgattcctaagtcaccgtgagttaataattctccgatagttagactgcctttgtacaatcctgccatcagtgaactcaaggtactgtattgaaataatttaactgtttctgacatattagacctcgtcttagtagaactcgtcaggtaagattgtttcacctagtgtcacgttatctttatagtcaataggcacatcaatcaacactggtccattttcagcatcgattagagcttgtttgagtgtttcttcaaaactgtctttgctgtctacacggtaacctttagcaccgaaactttcagcgtattttacaaaatcaactggtccaaagtcaacacctgaagaacgcccatacttcatttcttcttggaattcaaccatgttatattttccatcgttccaaataatgtgaacaattggtagatgaagacgaactgcagtttctaactcttgagctgagaataagaagccaccatcaccagaaactgaaataacttttgtgttgggacgcaaaagagccgcagaaattgcccaaggtagagcaactcctaatgtttgcattccgtttgagaaaagcaagtgacgcgcttcatatgatttaaagtagcgagccatccaaatataatggcttcccacatcaactgtaacagtcatgtcatcggtggtattttcttggagtacatcaatgagatcaagaggatgaacaagtccatgagctgagtcacgatcaaatttaacatcgctaacgttttcaatattattacgaagacctttcaaatactcttttgaaccttctggcaattcatatcctttaatagctggtaaaagtaaatcaagtgtatgtgccatgtctccaatcagttctcgctcgggttggaaatacgtatcaatttctgcttgttcaacgtcaataacaataatacgagcagaaatttcagcattccagttacgcgcctcatattcaatagggtcatacccgatagcaataactaggtctgcacgcttcaaaagcatatctccaggttgattacggaagaggcctacacgaccaaagaatgtttcatcctcgagctcacgtgacacaatacccgcaccttggaaagtttctactactggtagtttaacagcatcaagaagtcgacgtacggcagcagttactccctctgaagatgcgccatttcctaataacagtaccggtaaaacagcattgttaatagcttgcgctaaataattaatatctaaaacagatgccgaacccaatttaggtgcactaagaggtttgattgcttttactgagactggactgtctgtaacgtcttgaggaatagagataaaacttgctcctggtttaccagatttagcaagacgataggcgtttgcaacagtttctgacaaagtattagggtcatgaacctcagcagaatattttgtaataggttccagcatagcaacgttattcattgattgatgagcacgtttcaataaatctcctcgcttaacctgtccaccaattgctagaacagcatcaccttcatctgtcgcagtaactaaccctgttgccaagttcgagatcccaggtccactagttgcaataacaactcctggttctcccgtaatacgcccgacagcctgagccataaaagtcgcgttctgctcatgacgagcaacaattaactctggacctttatcttctagagtgtcaaatacgcggtcaatcttagctcctgggataccaaaaacatatttgacatcatgattaatgaggctatcgacaattaagtcagccccatattgattatgtgattctgtcattttatctccctcttttcacaagaatggttcaattatatcacagtttttacatcagattgtgaaaatttacttgtgaattatttatttttttctgtaagtgttttcctatttaaatgttattcacccattctgacatctctatatcatctggaactaattttaaataagcctttcctacttcttgtgccttatcaaggtaaccaaattctctcaaaatgtaagcataatcttgtaaaaattctggattatcttttaaatcattatacaaagattgataatagtctacactatcatccatttctaaagccttgtgtgctttagcgatattccattttgcaaggatattttctaaattatcattgtctaattccaagacttcctcaaaccgctcttcttcaagatacaaatttgacaatctcataacaatttcatcttgattttcagaaactttttcagcttgtttcaaataagactccgacgaatgaacatcatgtaattcatacgataattgtgaggctagtaagagaagttgaccatcaaaactatttttacgaataccttgctgaactagacgtaaagcttcttcagatttatgctcctcacgaagagataaaccatagatatattcatagccagcaaagtctggattaatagtatccaactgtttaaaataaaggttagctttttgatattcttcttgatcataaaggattgttgctaactcaaaaactgttaaatcatcatactcaatgtcaacggctttttctaaaaattcgatagctgcatcaaatttccccataatagcgtaggatttaccaatacgctgataagttgaaactccagtcgtttctaagatttctcgattgtcaagtgaggcatatccttctatcgcttcttgataatgttccaaactaaggttcatttcagctaaaccaaatgtaaccaatgggtcatcgctaagtttgctggctagcaaaagcttttcacgcgcaacatcagtcaagccttccatatcatataagtcagccataacaaggagggctgaaacatactcttgactatcttctgagatataatctaagtataagaatgcttgttcaatatctccatcttcggcaacaatttgagctaaattgatagcaacttctggataatttggtcggatttgatcatagagacgttttgcttggggtaaaaaaccaatactctccaaataagctcctagttccaacaagacttcctcaggatcatttttcaacgctttttcgaaatacttgttagcatgttctaaatcctgattttggatagaaacaatcattttttcactattcaacatttttaacttcttcacttctttcttcagtaacaacatctactgtatatagcccactgacagctttgtaccaatcaaacaattctttaacaacaactttgatagatgcataaatcggaatactgaggaatactccccaaacaccaaacatcgctccagaggttaataaaataaacataattgtaattggatgaatgctaagtttattacctaaaaccaagggtgagacaaagcgtccttctagagtttgctcaataacaaaaacaatcgcaactttaacaaccataacaggtcctgcgacaagcgctaagataaacactggaatttgggcgacaaaacttcccaaatagggaaccatatttaacacaccggcaataatccctaatgtcacgccatatctaaggcctataatactatacattattgaaaaaataacaccaacagtaatagcaacaatgatttgtccttgcacataccctgacatttgactattcatttctcgcaaaatacgatcagttggttggcgtagtttggttggtaaaaccattaagaaaccattcttcatgttgcgactatctcttaaaagataaaacaaaataaagggagccatgattgttgctactgtcacacgtgcaactgtactagctaaatttcctgcccaatctaaaatattctttgaaaatttttcagcataagagaccgcttggctactgatattagataacatgctcgatatttcccctttataagattttaaccaagggttgtgatctataaacgaacttgtttccatttgcactttattcacatatgaagggagatcttccataaaatggcgtaattgattactcatcatgggaataaaactagacattgcccaaattaacagaaggattataatagtaaaaactgataatatcgctgttacacgcttaattccccgcttctctaaaaatgtaaccataggttttaataggtaataaagcaagccagaaattacaagcggcaatatcagcacagcaagaaaatcaaacacaggtttaaacataaaagagattttggtaaaaataaaaatcgttaaaaataccaaaaaggtaatcatgagagcaataactgcttgattatttaagatccatttaaaaaacaaactatttttaaattctttttctgatggtcgattcattcacatatcctttcaagatgaattctaattttaattctcatttattataacacgttaaattaaattaaactcaaaacaagagagtaaaaagttaattttgaacaattttatgcacaacatgacctggccattctatcaaatcctgtgctaaaaaattaggattacaatcaatttttgttaattcttttattggaagccatacaaaatgtcgcttatgcgttccttctttgatagattctggcgcctgacccaagagattaacaaaatataaaaattcaactgagtgataatgatgtctcttaatattaaactgattctcaataatataggctaaatcaccaacttggctgtgaagacctatttcctcaagtacttctctcgcaacagccttattgctatcttctccaacttgaagcgccccacctggcaaatagtatttatcgagatgaggagcatatattaatagcagtttttgattttctatgattaaagcagaaactctgactccgaatgtttcgagctgttctctaaccctaaaatctctatttttcataaaaattaaccgtcttttcaattaaattttggtgttcatcataaacaaacttagcagaaaagaaaggaacatcttctaaaatccatttaaaaatttcgtaatctccttgccacgttggcttagaaagaacttgatcatatggtacccattctaaagttccttctcgtgattcatcatctgaaattaactctccttcataatctgttactttaaagacataggtataccaatcatgacctggcgtaaattcaggaaaagtgatgactcctttaaaatccattttttttaccgttaaatgggtttcttctagaatttcacgcttagcacattcatcaggagtttcacctgcctccagtttaccacctaccgagatccactttccctcatgaacatcattctcttttttgttgcggtgcaatagaagtaattccttgccattgtcaatgtaacaaattgttgctaatttagtcatttcaaactcctctcattctcatattataacaaaaaatagcctttatttaggcaatttactatcaaagtagcacacaaatgattaaacaaattattttgtttaccagttatttacttttcactttgatgacattttaaaggttctttatcataaacctttaaagcatgctataattaggaaaaaccggtttacaattttaaaacctaaggagtaaaaaatggaaatcaaaaagaaacatcgtattatgctttattcagcccttattttaggaacaatattggttaacaatagttaccaagctaaagctgaagagcttaccaaaactacctcaacgtcacaaataagagatactcaaactaataatgttgaagctccccagactgaaagtaccactgtcaaagagactagcaccacaaccacacaacaagatttgtctaactccacagcttcaaccgcaactgcaacagccactcctagcacaatgaaacaagtagtagataatcaaactcaaaataaggagctggtgaaaaacggagattttaatcaaactaaccctgtatctggaagctggtcacatacaggcgctagggaatggtctgcttggattgataaagaaaatactgctgataaatcacctattatccaacgtaccgaacaaggccaagtaagtctatccagcgacaaaggctttagaggtgctgtaacacaaaaagtgaacattgatcccactaaaaaatatgaggtcaagtttgatattgaaacaagtaacaaggctggacaagctttccttcgtattatggagaaaaaagataacaatacgcgactttggctttctgagatgaccagcggtactactaacaaacataccttaacaaagatatataacccaaagttagatgtctccgaggtgacacttgaactttattatgaaaaaggaacaggttctgttacttttgataatatatcaatgaaagcaaaaggccctaaagactcagagcatccacaacccgtcacaacacaaattgaaaaaagcgttaatacggctttaaacaaaaattacgtttttaataaagctgactaccaatacactctaaccaatccgtctcttgggaaaattgttggtggaatattgtatccaaacgctactggttcaacaactgttaaaatatctgataaatctggcaaaataattaaagaagtaccgttatcagttacagcttcaacagaagataactttacaaaactcctcgacaaatggaacgacgtgactattggtaatcatgtttacgatactaatgattcgaacatgcaaaagcttaatcagaaattagatgaaactaacgccaaaaacatcgaagctatcaaactggattctaatcgcactttcctttggaaagatttagataatctcaataattcagcacagttaaccgctacttatcgtcgtttggaagatttagctaaacaaatcaccaatccacactctactatttacaaaaatgaaaaagctattcgtactgtaaaagagagtctggcttggcttcatcaaaacttctacaatgttaataaagatatagaaggctctgccaattggtgggattttgaaatcggtgttcctcgctcaattacaggtaccctagctctcatgtataactacttcactgacgctgaaataaaaacttataccgacccaattgaacattttgttcctgatgcaggatttttccgtaaaacgcttgtcaatccatttaaagcccttggtggtaatctagtcgatatggggcgcgttaaaatcattgaaggtttacttcgtaaagacaatactattatcgaaaaaacttctcattctctaaaaaatctttttactactgctactaaagctgaaggcttctatgctgacggttcttacatcgaccatacgaatgttgcttatactggcgcctatggtaatgttctgatagatggtttgacacaattgctgcctatcattcaagaaactgactataaaatctctaatcaagaacttgatatggtttataaatggattaatcaatcatttttacctttaattgtaaaaggtgagttaatggatatgagtcgtggacgctcaattagtagagaggctgcttcttctcatgcggctgcagttgaagttctcagaggtttcctcagattggctaacatgtctaatgaagagcgaaacttagacctcaaatcaactattaaaacgattatcacttcaaataaattctacaacgtcttcaataacctcaaatcgtattccgatattgccaacatgaataagctgcttaatgacagtacagtcgctactaaacctttaaaaagtaatttatcaacctttaatagcatggaccgcttagcttattataatgccgagaaagactttggtttcgcactttcattacattctaaacgtaccctcaactatgaaggaatgaatgatgaaaatacacgtggttggtataccggagatggtatgttctatctttataatagtgatcaatctcattatagtaatcatttttggccaaccgtcaatccttataaaatggctggaacaactgaaaaagatgctaagcgtgaagatacgactaaggatttcatgagcaaacatagcaaagacgctaaagaaaaaaccggtcaagttacaggagcatctgactttgttggttccgtcaaacttaatgatcactttgctcttgccgctatggactttactaactgggatcgcaccttaacagcacaaaaaggttgggttatcttaaatgataagattgtctttttaggtagcaacatcaagaatactaacggcattggaaatgtttctacaacaattgatcaacgaaaagacgattctaaaacaccttatactacatacgtcaatggaaaaactgttgatttaaagcaagcaagttctcaacaatttacagatacaaagagtgtctttttagaatcaaaagaacctggtcgcaatattggttatatcttctttaaaaatagcactattgatattgaacgcaaagagcaaacaggtacttggaacagcattaatcgtacttctaaaaatacctcaatcgttagcaatccttttatcactataagccaaaagcatgacaacaaaggtgatagctatgattacatgatggttccaaacattgatcgcacaagttttgataaattagccaatagcaaagaagtagaattactagaaaacagttcaaaacaacaagttatctatgataaaaacagtcaaacttgggctgttatcaaacacgataatcaagagagtctcattaacaatcaattcaaaatgaataaagcgggactttacctagtacaaaaagttggtaatgactatcaaaatgtctattaccaacctcaaagcatgacaaaaacagaccaattagctatctaactagccgtacataaaaaacctatcatcaaaatgataggttttttggttcaattagttaatgacttcttgcgttttagcgtagttagcttcaactgcttctttctctgctttccaccaatcttggttttcagtgtaccagttgattgtttcttccaaaccttctgagaagtttgtgaattgtggttcccaaccaagttcttcacgcaattttgtagaatcgatagcgtaacgaaggtcgtgtccagcacggtcagttacgtgatcgtaagcgtcttttggttgacccattttctcaaggataagttcaagaacttccttgttgtttttctcaccgtcggcaccaataaggtatgtttcaccaatacgacccttagtcaaaatagcccagacacctgttgaatgatcatttgtgtggatccagtcacggacgtttttaccttcaccataaagtttcggtttgattcctgccaagatatttgtaatttgacgtggaatgaatttttcgatgtgttggtatggtccatagttatttgaacagttcgaaatggtcgcttttacgccgaaggaacgtacccatgccttaacgataaggtcagaagctgccttagttgatgagtaaggtgatgatggattgtattttgtttcagcagtgaatttttcacctggtccttcaccatttcctggaaggtcttcacgaagtggcagatctccataaacttcatcagttgacacgtggtggaaacggatatcgtatttacgagctgcttcaagcaaagtgtaagttccgataaagtttgtatggataaatggacttggatcgttaagtgagttgtcattgtggctctcagccgcatagtgaacaatagcatctgctttggcagccaacttgtctaccaattcagcgtcagcgatgtcaccaacaactaactcaacacgatcaccaagaatggcttcaatgttagcacggttacctgcatatgtcaatttatcaaggacagttacatgaacatctgggtggttattgtaaacatagtgtacaaagtttgatccgatgaaaccagctccaccagttacgataatgtttttaaattcagtcattttttctccgaaaaattttttctttttgctatttgaaggatactgttctgttagaagtagttctatggaatgtcatgcctaagaaatcaatatttcaaatccctgagggaacaggccttttgcatgtttcctttcacccttgcgtcaaacaacattgctaattcgtttttacttgctaaggttaatgccttttaagaagttgaaaattacaaatcttccttcttcaaaggttttacatctttgagaagtgggtgattcttatctgcttctgagacttctgcttcttcaaggttttcccactgaatgcctagatttggatctgcataattaacgaaagcatattttggtttgagttcaagtgcccaataatcgttaacgagataagtataagctgctttatctgaaagaacttggaaaccattagcaacaccgcgtggaacaaagataccttttgaggcatcgataatcgtttggtaaacgttaccaaaactgtcaccttcacggaggtcaacccaagtaccgatcacacgtccttcatcagcgatcgaaacatatttatcccaaggctctgcatggagacctcgcaaagtatttttcttgttaaacgaaatattattttgtagtttgtctgcctcaaagaagctttctgggaaaccaagcggtatcattttttctttttgaaagttctctttgaaccatcctcggttgtctccacgaacgggaatatcgaattccaacaatccaggaatagcttcaattgggcgacaagttaattctttatcaaaaaattgttcagtcattaggcttctccaatcaaacgaagtaggtattgaccatactcatttttcttaagtggttgtgccaactcaaggacttgttcacgagtgatgtagcccatgcggtaagcaatttcctcaaggttagcaacttgaacgttttgcatgcgttgtactgtttcaatatattgtgctgcttcaagaagactttcgtgagttccagtgtctaaccacgcaaatccacgtcccattaactcaactgataagtcacctctatcaaggtaggctttgttaacatcagtaatttcaagttctccacgagggcttggcttaatatttttagcgatttcaaccacatcgttatcatagaaataaagacctgtgacagcataattagacttaggttgcgctggtttttcttcaatagaaatggcattcatatcagtatcaaactcgacaacaccaaaacgttctggatcttttacttgatagccaaagacggttgctccactttctttactagctgcacgttgtagcattgcagataaacctggtccatggtaaatattatcacctaatactaaagcaacgtgatcatcaccaataaaatcttcaccgataatgaaggcctgtgctaacccatctgggcttggttgttcagcataagaaagagagattcctagttctgaaccatctccaagcatatcttcaaagcgaggcaaatcttgtggagtagaaataatcagtatttcttttattcctgctaacatcaaaactgacaatggataataaatcattggtttatcataaattggcatcaattgttttgatgcagcacgagttaatgggtacaagcgagtacctgaacctcccgctaaaataatacctttcatagtaaggtctccttatttatattaatcctacatattataacactttttttaaacgctatcatctactaatctttttcacgtattttgtaatatcgtaatcctctaaatttagctgattttctttatttaagattaattgacataattcataaccaattaatgggcccactgttaagccagttgatcctaatccacttgcagcatatgcaccctccatacaagggacagggccaaaaaatggagaaaaatcacttgtataggcacgaattccaacacgttcagaagtcgtatctgctttttttaattgcggaaaatagccaatagcttgctcttcaaacttgtctaagactttaaaatcaatgtttaaatcaaaagccatatcattttcgtgacttgcacctacagagactttaccattatcaaatgggataatatctagctcaccttctggcattacaacaggatattttcctgtattaatattgctaaaataatagtctcgcaattgccctttttgagggcgaacatctacctgatagttgtgctcatctaatatcttagctagccaggctccactcgctaaaacaagtttatcaaaatcaattccttgaacacgaaagccattatcagttatcgtaaagtgaacttcatccttgatgacattaacaccacttgcttctaacaatattcgtgttaagtccgccccttctactcgtgctcctccgctcgcataaagtaactgttcatagccatctaactcaggaaagtgagtatttgcttcacttttatttagtatttgtaaatcacctattagaggagattctagtcgacgtttatctgctagtgcaaacaatgactctaactgactctcgtccttttttaataagaaaacaccagtttgctgataaaattttgtttcaaaaccatctttttgtaaatccgtgactagctttgaataaaaatcagcccccaacctcgccatacgataccaggctttattacgacgttttgaaaaccatgggctaataatccccgcagcagccttagttgcttgtccaactccataatcaaaaacagtaacctgaatatccttttcttttgataagtaataggctagtgtcgctccgactgctcctgcaccaataattgctatctttttcataatagctcctacatatggtaaaagggatttgttggagctttactctctaaaactgaaatatcccagcctttttcaagtttccactgctcaatcatagtagctattttagaaacaaataaaacctcaatatgatgacctgggtcaatcgcaagcaaaccatttgtgatcatttcttgtgcagtatgataataaatatctcccgttacaaaaacatctgctccttttgcaatagcttctttgtagaaactttgcccactacccccacaaatagcaactcgttgaatttcaggattagatttatcatatgaaactaaacgaacgctatctaaaccaaacacatctttaattttccatgcaaaaaattcaaaactctggggtctaatatcaccaatgcgaccaataccataaccattacttgtctcagataatatatcgggatattgaatatctaataattcacaaaaccagtcgttaagtccattaggaacgatatctatattagtatggctcacataaacagcaatgtctgatttaagaaggtctatataaatcttattttgcggcgttgctaccaaatcctttaatggacgaaaaataggagcatgctttacaataagaagatctacttgacgttcaattgcttcagctactgtagtctctcgaacatctaaagctaccatgactgtctttatttctttatctaaagatccaatttgaagacctgaaatatctccttccatagataattcctgtggacaataagtttcatatacatcaataagttctctagctttcatcaagaacctcctttatatcctgtattttatcttccaaaatagcgcgttcttccattttactattgggaatagagtttaaagcaaaagttaatttattaagctcattttgccatttttctttaaaaaccgttgtgttattggataataaaaatggaccaaatcgcaattctttagcagttaaattcatatgaccatgcttaacaactaaaatttcatagcgtttgtcattttcagtcaagatatcttctgctactatttcaaaatcatttgcagctaaccattttcttaaatcatcttcccgattattaggttgtaagactagtgttttaacgtgctgaagtttgtctatatcgttattcaaaatatcagcaatcaaacgaccacccattccacagatagttatcgtatcaatattatctgcttcttcaaaagctgacaaaccatttgctaagcgaacatctatctttgaagtgagaccatgttctgaaacgtttttcaacgcagactgatacggtccattcaccacttcaccagcaatggcaaaatcacagtatcccatctgcaacaaaaaaataggtaagtaagcatgatcacttcctacatctaataaccgagctccttttggaacgtagtttgcaactttttgtaatcgttttgataattgtaaatccattgtatttccttcagtttttctctgttaaaagtataacatcattaacatcaaaagaaaaggagcagacctaatgtatcaaccattctgtctcctcctagtaaacttattcccataaattcattgcatttttaaaatcatccgaaatcgctaaatctttcatttggttatcttcacgtgcttgttttctctcttcaatttgtcgaagtgtcgtcaatccttcacgccgccagttgcgaaggatagcattgatataattccaacttgttttcccattgaaaaccgcttctctaagagctgccctaacaatatcaggatctgtctgatcttcttgcagtgtcttttgtaaatcttctaattcaaaaggacttaataagcgacctaattcacgttcgaagtctcctactaaatctttcagacgattcgaatcagaggttttattgtctattattacttgattatcctcttcgaaaagtttatctaatttagcaaacacagggcttgtatcaaagataatctcgatttcatgattcaactcaattgttttgacatctagtaaaccttgacttgttaaattcgatatagaacgattgatatctgccactgttttatcaagtgatgtcgcaatacggctcggtgttagatcggataaattagttgtattttgtaaatagaaaaattgccaaactaaaaaatcgtctgctgtcttaaaaatagatttaaagtgaaaaaataaagcacttggtagagtcaattgccctgactgatattgttccaaataagtcataacctttcaaatcctctctatcgtcctaaaattatgaaatgtgtaacaaaaagcacctctcaactattatcatagcacttagaggcgcccttatcattcatctatcttgaataggccttatcctggaaagttcatcaataccttagtatcataaccttcaatagctttacgaccatttaatccatcaagttcaactaggaaagcacagcctgcgacaacgccaccaagtttttcaatcatttcaattgtcgcttttactgttccaccagtagctaaaaggtcatcaacaattaaaacacgttggcctggtttaatagcatctgcgtgcattgtcaatgtatcaagaccatattctttttcatagtcagctgaaataacttcgcgtggtaatttacctggtttacggactggagcaaaaccaataccaagagcataagcaactgggcaaccaacaataaagccacgagcttctggtccaacaatcatatcaatatctttatcagcagcatattgtacaatttcacgaacagcatagctgtatgctttaccatcagccattaatggggagatatcacggaaagtaattccttcttgaggatagttttcaattgaagcgatgtaattatttaaatccatttcacttgtctttctaaggggaaacccctaaaatgttttactcttcattatatcataaaattaaataaaatagtactggaaactttaaaaccatatgctagttttgcatatggttttaaaaattaggcatctgttaccttgacaaaaggtgctccaatatcaattctatcctcactataatagctctgttctttccaaagttgtgaaattggataccaaccagacaaggacggtgtgtaagggtcagagacatgtgtcagtccgttattatatcctttgagaacgatttcatgacttccatgaagaacaaaaacattattttgtactgccgctaggacatgataaccatccttcaacgcttgtacaaggttagcttgagttcctaatgcagttgcagttacaccccattctttggctgcttttaaaattcctctagaagttgttccttgaacaccacgattaaattcaactgtcttatggtaaaggtaatctgcaatttgcgttggtaaaacagtttctcctttcaaagaagacaaaatcatagctagagaagttggtacacaaccagtttctcctaaagttgccataccatatcttcgacttgcccaccttccatcacgttggctaaagtaaggagtattataatttgaatgtgcgacttgtagagaagtttttaccaataattgtttttgattagaagcattttcctgataaacatggataaagtatttaccattgtctctatgatttgtaacattaaatgtcaatgtagcttcatgatttttgggtgcgacggtataccacttaaggtcatcctgattgtttttatctgaccaaatagcaatttttaaatccccaggactaataacatttgtcactcgtacattatagtttccagttcccttataagtcgtttggacagttaccggtattttagcagtctcaactaatttaatttcgattgcttcaattcgttttccttggttagtactaccagcgatgtcattgttataagtccaatcctgccaaccataatcttgcatgtgaactcgatacatcacactataggttttcgatagcagacctgtcaatcgcatctgaatagcttctacttgttgagattcatttggtacattactttctctccctgaattaacaacagtttgccaacctgaaccattaagaaaagttctatattctatatttcctagagctgtactacctaagttaagtttgatggcttttatagattttgaaagtccaatactacctcctaattggccttccaaaaccgttggtttccaaccatctttttgaagataagtttgataacttaatccaggatgcttcatttctaagaatgaatgatttgtttgggaactaaaatctgaagctttagctactagttttacctccaaagcctctaaacgtttcgattctccgactgtacctgctacactattatttttttgccaagccatccaacctttatcttggacgtgagcgcgataataaatatcataattttgttttaaattcccacttaagtccaattgaatagcttctagtctttttccttgataatccttacttgtttgactacctaaaatttctccccaacctttatcttgtacatgagtacgatagagaatgtccccatacttcaaggtgctaagagtgaattttactccatctagggctttggattctcctaaagttcccgccatttgtccttcaagtttattagattgccaaccattttggcctaccttaacctgataatttaagacaggtctctcttccttaggtatagttggtgttaaaacagattgtcctttaagggtaaattttacttcgtaagcttcaaggcgctttgacattcccaaagtcccagcgtaagctccatttttagcccaagccatccacccgatatcttgaacatgaacacgataatagacatcatataatttttgtaaattatcagtaaggttaatgcttagtgcttcaataggtctactctgaccaacagtaccactaacttgaccactctctactgaaggttgccaaccttgtcctttaacataagttttatagctaagttttcctgttattccttcaggtgctttaatagacaattttattgcctcaacctgcttttcttgtcctactgttcctgaaactgttgcattatcaaccgacttttgccatccaatatcttgaacatgagcagagtaagtcactgttggtaattgctttgttgaattttgttgagtaataacttcactatcattagctacttgattaacattagaatttgtttgatttgctgagtgctcagcagtactagcttttacaacaacttttgagctagcatcaaaggttttgactggggtagctgctatctctctaggattagatgaaacagatgtagcaaaggctgtttttattaaaggctctgcactatttttcatagcctccgaggaattaacaggtaacgttaacttggaagtatccgaaatagtctgactgctatcagttttctctgagatcgttgaagttactgcttctgcctgttctgccttgacatcttgaccaagaattgcactaccacctaaaatggtaacgatacctgcaacgacccaaaatttgccttttttgtacatcttttttctaacgataggtctcatagattttatcctcgcctttaatattctttatcaaaaattccattattttcttaattttattatattttaataatatttgcaatattattattgaaataacttatttatataccaaaaaaaccacttaaaaagtggtttctttagtatattatcaactcatcataaaatcatatatttctttaggtgtccctaaagccattaattcttgaaacttaactgtctcttttaattcttgataaatttgactctcagagatatctcgcttttctgcttctttattgactgtcataatcccttctgtaatcgtaacaaaatgtagttcttcaaaaatttgaatcattttaattaataaaatatcagggatatgaaggtaggaactgagctcttttaacttataacgaacgtcaaattctgggaattgatatattgttttatataaactagcaaactgatcacgtgtaccataaccagatataaaataattttttggtatctcatttttaaaatagatggcatcaaactgtttaccttgagtcatttgttttaattcttgtggatgatcgggaacagtcaaaagaataacttctttgctctgctcttcttgagacaggattggcactccatgaggtaaactacttgctttgcttctaatatcaaataattgaataccgtctacacgcgcatcctccaacattaattgtagggttgtggcaccattccattgattaacagataaagtgacagctaactccaaatgttgtgcttgttggaactcttgtagttgactccccatattaaatgctaccaaatcaagtgcttgtccatcttgttctagttttaatttcagatgagcaccgttttgccccatgactctggcttgactcactttaaaatcttttaacaaaaagactggttttttattatccattccaaatggcgctaacttttcaaaatctctaacagtgtctaaactaagttcgtcaaaacgtagctcactatcaattgtcagagtttttttctgactcatgtccaattgttttttagagatatagtcacataaaacttgagaaagatcacctactttactttcctctaaagtcatgcctgctgctccgctgtgacctccaaaagcaatgaataattctcgatgctggtcaaaagcttgaaaaatatcaagtgcttctacacttctggcacttcctttagcaataccatcttcaatattcaaaacaataacaggttgtccagttctctctaaaatacgacccgccacaatacctaaaacccctggatgccaattttcttttgctaaaacttgtacaggctttgtttgatcaagcatttgcatagcttggtcaaagatagtttgaacgatttctttgcgctcttcatttttttgatcaatcatttgggctattgcttgagattcttcatcatcaaaccctgttagtaattcaatagctggattagggtcatcaagtcttcctaaagcgtttaattgtggagcaattttaaatccaatagtttcttcatttagtgtttttaaatcaatatttgataaagatattagctcctgtaagcctattctttcactatctttcataacttcaagtccagcttttaccatgatacgattttcatcagttaggctaaccatatctgcaatcgtcccaatagcaaccaaatccaacatttctgtcgggattgtttctaagagagcacaagctactttgaaagcaacaccacaccctgctaaataaggaaatggataattagcatcaggatgttctgggtgaataatagcataagcacaaggtaaatctgctggcatactgtgatgatcagtaactaccacgtccacaccttgattttgagcatatgtaattgcttcatgccctgccacaccattatcaaccgtaatgattaatgaaacatcttgttgttcaataaaatatttataaacactttgattgggaccgtaaccatctgtaaagcgatttgggagataaacctggacttcagctcccatcatatctaatgcttctttcatgattgatgctgatgtcattccatcagcatcatagtctccataaactaaaatagtttcattattttcaatagctcgtctaatacgattaacagctttatccatatcatttaacaaataaggatcatggagattttccaaattagtttgtaaaaaatgatgtaattccgctgatgtcttaatacctcgcgaataaattaaggaagccaccgcttcacttatcttttctttttttgaagcctcaaaaaagccagcgtctggcttttggttattgaggacccaactatacttagcagatatcatttataattgaatacctttctggcaaaataatcagctgtttttggaaataaactataatatttatgcgcaaaagctaatataaaaggaagatttaattctctcttattttttccaagaatagaaactacttttttagatactttttctggtgttagagcaaaacgacctatacttgctaaataatcaccacttggatcagcctgagcaaaaaatcctgttttgattggtccagggtttacacttgtcacataaacatttttttctgctaattctaaacgaagagcattcgaaaatccaacgacagcaaacttactagccccataaacgctagctttacttgttgctatgaggccagccatgcttgcaatattaacgatatgaccagattttacaagagacatcttatgtcctatctgacgagctatagacatcgttgcaaatgtattcacagcaaacatgtctttgacttcttcatcactataatcccaaaattctttaaaagaaccaaatccagcattattaattaaaatatcaatttgaccaaattcaccataaattttttcaatcatattcgttacagcattgtcattagttatatctagtgataaacataaggtgtttggtctctttccataaagcttttcaagtttttctcttgatctccctgtgacaattaaatggtcgtcttggggtaattggttaataattgcctgtgctaaaccaccagaagctcctgtaatcagtatcgttcttgccattttatatacctacttcttccaaatctctaacaagatgggtatttgaaaaaatcgtctttgcatcttcttccatttgccaacaatctcgccccataaaacgagcactaacatgatttaataatagtcgtttagcatttgcttgtttagcgatatcagctgcttgcatattggttgaatgcccatgcgatttagcaattcgctcatcacccttaccataagtagattcgtgaactaaaacatcagcgcccaaagctaacctaatacttgcatctgtttttctagtatctcccaaaatagtgattactttaccctttttcggttcagaaatataatctttagcaataatttctctaccatcttctaaggtaacattctcaccatttttgactttcccaaaaagaggaccaaatggaacacctgctagtttcaatgcttcagcatctaaagtgccctcaagatctttttgcacaacacgatatcccatacaaaagatagtatgatctagcttttctgcataaacggtaaatttatctgtttccataatttttccgagtgatgattcatcaaactcgtgaaaatggattcgataaggtaaacgtgaacctgatgtccttaaggcagtcataacaaaactttttataccaaccggtccataaatatctaaatctgtctgctcttcattggcttgaaaagcccgactggataaaaaacctggaagaccaaaaacatggtctccgtgcatgtgcgtgataaaaatttttttaactttacgaggtttaatcgtagtttctaaaatttgacgctgtgtaccctctccacaatcaaacatccaaacctcgttaatttcatctaataatttcaagactaaacttgaaacattacgagctttcgctggttgaccagctccagttcctaaaaattgaatttccatacttgttgacttttttataatccttccataacttaataaatttaattagtagatttagtatcaatataaataactgactcacgtccttgactagaataatagtatttacctgactttgttttaaccaactctaatagctcttcttgattgaaactagttattttaataatatcttttttaagttgtaagacattccctagtaaacttgtttctggtgtaatattttgagattctgtttcgtcaaaatctatttttgccattctgataccagaccgatctcgatagactttatattgaggaaaaatctgtgcaatttctaagagtaactgcggtgtaatgacttctttaacttcagaaaaaacactcgcttcttcttgatcatttaggtaagcaaaaccaaatgattttcctgataaattcaaacgaataaaaggtttttcttcatcaaacgataaatgttttggaaacaagcccaaggctttggaaagatcaaaatagtaatcagttgcagcttctggcccttgcttttgatatatttcagcaaaataagcattaatcacactaggaggtggggtgataaaatcaagtcgttgctgcttagagaggccatctagttttttctctagataaactttatctaagctcgtaaaaccaccataagtcaaagctaaatcaatataatcaatcataaaattcttccagcttccatttttgtttaggagaaatatagcctgtaatattctcgtattcttcttcaaaggtgtaggtatcaagcaatgctattttattgagatcatagagcttatatgcttgattttgatgcactctaatcgaaaattcgtcaaagatatgtcgtatttcatccacaataagacggcgtaataaatccttactcccttgttttttggctgcaattctcacatttggaaaagttgttgcattcagctgctcagtgacatccatcttgttgtatatcgctaaacgaggaatatctatcatatctaagtctttaagaatctccataacaactttttcgtgttcttcatgattagggtcactagcatcaataacatgaaataataaatcgacatgtcgactttcttctaaggtagacttgaaagccgcaactaactctgtaggtaaatcttgaataaaaccaacagtatctgttaaagtgacttgaaattgattttgtaaatagatctgcttggttgtagcgtctaacgttgcaaataattcattggcttcatattgcttatcatcggttaaaacattcataatagttgacttgccagcatttgtatatccaattaatccaattttaaaggttgtcgaatcaacacgtctttctcgaactgtctcgcgatttttttctacaatcttcaattgtctttcgatatcagaaatttgatgacgaatggaacgacgattcaactctaactgagattctcctggacctcggcttccgattcctcctgcttgacgactaagcataataccttgtccaactaagcgtggtaacatatatttcaattgcgctagatgaacctgtaattttccttcatgacttctagcacgcatagcaaagatatctaaaataagttgcatacggtcaataactttaacaccaagttcagcttccaaattagagttttgtcgcggagtcaaacgattattaaccacaacggtatcaatctcatctgcttctacaatagcttttatctcctctaatttaccagatccgataaatgatttactatcatatttatctcttttttgataataatgattaacaacatttgctcctgctgtcttagctaagctagcaagttcttccatggacatttcaaaattctcagtatcttgaagttctaccccaactaaaataacacgttcttgctcttctttagtttctatcacctataatctcctttcaatatttttttcttgttctaaatacgtaatctttattataacataatgccctttaaatgcgagaaacggctttatttactttgatgataaaaaatcactgacttttcgcttgattttttgttgataattttcctcaccaaccataataaattcgacattcatacggtttctaaaccatgttaattggcgttttgcaaaacgtctggtattttgttttagtttatcaacagcttcttctaatggtatttgctttgaaaagtaaggaaataattctttatagccaattcctttacttgcttgaacactcgggtagttatcgtatagccatttagcttcatctaagagaccattgtccatcatcaaatcaactcgtctattgatacgatcataaagcacctgacgatcatcattcaatccaattaataaaacatcatacggactttcactattttgcaaatcattcccaaacttcgccaattctaatgcacgaatggcacgtcgacgattaacttgtggtataataatggattgttctgtcaacttttcaaataaatcttcatcacttagagactctaatttttcacgataggccataagagtttcttgattgacttcgcctcctaaatgatagccctcaaacaaactctgtaaatataggccagtacctccaacaataataggaattttccccttagaaataatcgtatcaatagctacttttgcctctttgacgaaatcataaaccgaatagttctcatttacttcacgaacatcaatcaagtgatgataagcttgttcttgctcttctttactagctttagccgttccgatatctaacttctgataaacttgctgactatcaccactaatgatttcgccattgaaagttttagctaattcaattcctaatgctgtcttcccaaccgcagttggaccaacaactgctataagtttgatttttctcatgatacttctcaattctataaaggtttttacttgaaatttaactagtatttcgttaccataattatatcatagatagaagcagagtcttcatcatagattggagaattattatggttaaaaaattcgcatttgctaaaggaatagcaacaggagtcgttgcaacagctgctactcttgcaggtgctgcatttgctatcaaaaaaacaattattgaacctgaggaagaaaaaatagcttttatcgaagaaaatcgtaaaaaagctgcacgtaaacgtgtctctcattaaataataactcccttactagctagtaagggagttattttatattaaattgttcgccttaaaaagaaaatataacgtaccattactatcataacaataagagttgttgtcccaatttcaaagtggactagcccctgtatatcaactggtaatgatagatgctgaatacttaatttaagtgaggtagctgagataacaagggggaaagtaaaggctgagaaacctggtgtaaaatcaccaatcagtaatttaggcacctgaaaaagaatgaaaaaataaagaaattgtgccattacgattaatagcagtaataaacctctatttggtgacacaaaactattgacatatcccgctgtgattagcgacattggagcgcaaatagtagttatattaggcttaactgccgaaggtagcccgattttatatgctttaatgaatagaaatggtaataatactaaagttgcaataaaaccataccaaaagactattttcccaatagtaaattgtccactaattggtgctgtcaggctagctacccctataccaacatagaggacagaccaagaaggaaaaagattagccatcgaaaagtgtctcaaatatttccatgaaaaaatagccatatgaatgattaacgcaataaatgacaaccaccatacaccttttgacagaactgctacccatattcctaaacttctaaataataagatataggttgataaaatcatacctgccataaaaaaagtagtaaagacagaagcaatcaaaggattgcttaactccttcctgctttcttttttattttttaatattcctttgattaaaaaaatccaaaaaacaagtgctactagccctaaacaatagcgaacataggtgccatatccctctagaaggttccccaaagctaatagccctaatactaatcccgccatcactaatggtggtttttcccaatttttcatcatatacctcataaaaaaacgtttacatctattataacacaattagattttgctgataagtgattttattaacttaatgaaaagaagctagtccattgactaacttcttttttaagctcttctaaagtttgcttttattttaagtgacgattcctctttaaagagagacctactagagcaagtagacttgctagaatgcttattcctactacacttagtatttttgatgacttatctccagtttttggcaaattagcttcatttgtcagatatgaatcggccttcttagaaactacaggagttattgaggtcttattagctattctatttactttttctaccgttttagattccttgaaagattgtgttttgggataatctgcttgcaattcctccttagggctaggagcaactttgccaactttaatcacaattgctgttaatggatcaatcagcaaactatctttttcaaaatgaacacctctaggagttgagattggtttaatccccgcttgatcagcatcaacaattacttgcccttttaaaaggtgtttatatttttcacctagtaaaacgtttctagctttactatcagcattaacaaatactgcgtaaatatcacctttagaatctattgtttggtaagcaataaccaaatctttttctttaatatcaccttgacctacctctgtaatcaagctaacctcacgatcaatttctgctttgctcaattttcggaaagcatctgttgaacgccttaatgtgattaaacctgctgtataggcctgtgttttcgttgaaattgggtgtttgttattatctgtggctgctgcccaatcaaaatgattaatggcatctgaagaatcatatgaatcatgaataaaatatgggtattctttaacagcttcaataagtgttgctttattaggcaatttgtcatctgaaacttttgtcatgtaatcagggttaagtaaacgcttcgtacgaccatactcttgaccagaatgaatgaatgctgtcccttgagatgttaaaatcattacatttcctaaacgcagacgtctatgaatctcttcttcagctaccttagggtctttattaattgattttgcaatcacatcatgcaaggtaaggttatcatgtgcagcaatatactgcaccacatctcctggcgaatctgcttcaaaattcccaggttgtgctttgatatttttaaaaataccttgtaaagattgtgggccacctgtgatgaaagctggagtaccttcatttggaaaaccagatttcaagctattacgaatatcatctgaaaagacgccaactgtatcggttgacttcatccaatcttggtcagctggtttaaccggctgaccttgatcgccttggaatgttctccagccctcaccaatcataatcatattaggattaatagctttagcttctttataagctaattcaatcgcagccgcatcatgatctcccatcatatcaaaacggaaaccatcaactttaaattcacttgtaagatatttaatggaatcaaccaaaacacgacgactcattgcatgagtggttcctaaacgtccccctccaaaactttctcttggtgaaccatcttcattcataaagtgataataattaggttctatatcctcaaagagataagtttttgcagtgtgattatagacgacatcaagtataacccccatgccacgtttatgaatatcatgtattaattgttttaattcggcgatacgtgctgatggatcttttggtttctctgaatacatcccagaaagagcaaaatagctctgtgggtcatagccccaattgtaattattgtctgaggaagtgtaagctgttgagcgtgacttatccatttcattaacataaaaataactcaataccggtaaaagctgaatgtgtgtaactcctaatttctgtaaataatctagtttctctgaaaaggctgcaaaggtaccaaattgattttttaattttccatccaaagatcgatcagaagtgaagtctcttacatgtgcttcgtatataacagcatcttgtcttcctttaaaattagcaattttagcaaaacttaaattttgaggtccaagttgacttggatttacaaaagctgctttagccgttttaatatcatcattaacagtattactatcccactctgctaatgactttgcataaggatctaaaatcttaaccttatccttacctctttttatttcgtaaagataatagtaaccagtatagtttttaatacctaatttagtatcaagtatcgtctgccaaacacctttattatttttcataaggggggtagtcgctacaaccctgttttggttatctttgtcataaataatcatagtgacactatcagcactcggtgaccagaggctggcttcaacttttgaaccatcttgattgagaactgcacctaaatttccactataagcataaagttggtctttaaattcccaagattgccttgtcatgacattgttaccattataagatatgttgaaatgaccttgtttaggattaaagtcgcctttgattattaaaagagatttactagtatcgagagtgatatcagaaatttgtatagcattttgatttttatcagtcactttcaattcttttaaaatttcagttttatctaccccatctagagttgtaaaacttgcttgaatacttgttaaatcaatttgttgggcatcctttagctgcacttgatcaatgtaataaggattattataaacctttggatccttatcttttacaaaaatttggttatggttagctaaatctctaaaaacatagtcgttgggttgaactttcactgcatctcctgtcttactttcatctaagattagaaaaccaatctctttggcgttagtttttagtgatacatcaatataccttccatatagtccttgattcacaaaattactaccatctggccaagttgttgagggggttgcaacatctttaaagagccatgctgataagtggtcatagttactagaggaactcaaatagttaatacggacatacccttctttgaggggttgataagtatgtgtaccgtacttttcatcaatccaaacttggttcatctcaggtcgtaataatggaatatgatgatcgccgcttaaatttgtccctgctttgttattaattaaaaaagatatttgttttcgttgtttttcagataatttaaaatcaacataataaccgtaatcatctttcttagcatcagtcatagggatagcaccatttggccaattactagacggttgatcaacatctccccatatccaaagtccagtgctttctacaggatgaccttgaggcaattctttaagatgtagcctaaagtaaccattttcaatccgtggagcttgattagctactttcaaggtagggcttggagcacctatagcttgagaagttttgtcgggagtattttgcaatgtagatggtgctacttttaaatctaaggtatttttatctgaaacaggacctttattttcttcaagcaggcttgtcgccttatccggctctgtcactcccttttgagtgtcagtttcatctgatactaattgcttggtatccggcatatctgagggtgtcacaaccgtctcagagtttgagtttatgtcatcttttaaattagtagattgttggttgtcaacctgattaatattcgactctgcaatcgctgtatttgcaggagaagcacttacttcttcagcaaatacctgtggactatgaagaaaaatacatacccctgttgcaactgaagctactccaacacttaactttctaatcgtgtattgagtttgtttatcaccaaataagtcttttcttttcatatcattctccttttttaatgaattgttaccaataaaatcataacaatttacgcaagcgcttgcaacaagtaaatgatttctttatttttttgaaattttcactaaaactatcaatagcattacaaaaaagctaagcaatattgcctagcttttttatcaaaaatttcctcatatcaaatgattttcatcaatttgatagtcctttagcagaccttgaagtctatcaaattcataacaaaaatgttcaggaatatgaccgtcagagcctatagagtattgtttacaaccaagctgtttgagtatctctaaagcatagcgataaagtttttcattcccatatagataaagggatttggtatttagttcaaaagctaaccccttagataacatctttatgaaaatgcgcttcaattgcgtttcaaacggttttaaatcttctacatctaagtttaacttacgaaaaccataatcaaagtgagctaaaacgtgcgcttccacacggcctatggcaaattccatacgattaaagtaatctgctaaaagctcctttgttggtactttcagagcttcttcttgcagataatcatacctaccattatgatggattgacaatagttttaaatcaaattctttattttttaaataatctaaaatatctgattccctatctttaaaataaccgatttcaattcctttttaaatcgatttccatatttctgattaagataatctattttttgacaataagcactataatcaggaacatcgtcttgaccggtgtaaggatttgataaatcaaaatgttctgttgtgataaattcacctgtaaaaccattaatatagtcctcaaatgccgtttgacaatcataggaaaaatacgtgtgtagatgattatctctcataccaactcctatccttaatcttttaaaatatctgctactatcttttgtaaatcaacgattagatctttttcaaaccatggattcttctttagccaaatttgatttcgcggtgatgggtgaaccaggggtaaataatcgggtagatagtctttgtaagctttaactgtttctgttagatttttatgtgcggagcttccaagataatatttctgagtatactgaccaactagcaaggtcaattgaacattaggcatttcttttaaaataagagggtgccatttctccgcaaaaccttttctaggggataaatctcctgattttcctttgcctgggtaataaaaatctaaaggtaaaacagcaaattttccagaatggtaaaatgtctcttcatcaactccaagccactggcgtagacgatctccagatttatctttccaatagagtcttgcttcttgagtttttaaaccaggtgcttggccaacaatattgatcctagctgttttaggagcagcaaacaaaggatcaataccattttctgtataattttgattctgtgaatcactttttattgctttaataattttttccaagtcagtcataaagtctccaaatctaaccttatgaaaagaggcaaagacactttcatgtcttcaccaccctttatcattgatcacatatttagtttaaggattattttatttgattaattcatagatagcttctgcgtagatagcagccgaacggaaaatattttctaaaggcatgtactcattagcttgatgcatagtgttttcatctcctgggaacatggcaccgtatgcaacaccccgttcaagtaagcgaccaaatgtcccaccaccaataacctgttcatgtcctttaagaccagtttgcttttcatagacagctagtaaggttgatactaattcatcgtccataggtacatagtgtggtgtgtgttcatggtcagaaagagtcactttttcaactccgttaagtttctcaagcttagtttggatagttttagcatctgtcccttgtgggtaacggaaattaagagcgatagtattatcatcattagtttcatcaaactggaagacacctgcattcatgctcaatggtcccatacagtcatcttcataagctactccaagtttttcacctgagaagtcttcgtgaataatgttggctgtaacatctaagaaagcacgagcaggaccttcaaaatcaaattgacttagataaagagctaaataagtcgccccattaacaccttcttgtggtgttgaaccatgagcagatttaccataaactgttgctgtatattgctcatcttctacagataattctgctttcaaattatgtttacttgcaaaatcagctagactagccccaagtgttgtctgatctaaatgacttgtgaaacgtgctgtggctgattctggaaccatgttttcgcgaagtccgccagaaaagctatgcagtctaacagctcccttattttctcctgaaaaatgtaaatattcagtaatattacctttttcaccatttataattggaaattctgcatctggagagaaaccaaaatcaggttttggaagaccaacatgttcgaagtagtaatccatatctccccatccagattcttcatcagttcctacaacaaaacgaactttcttagatgttggtagcccaagctctttaataatttttagagcataataacatgccattgttggtcccttatcgtctgatgagcctcgagcatataaacggttatccttgataactggttcataagggtctgtatcccaaccgctgcctgcaggaacaacatctaaatgcccaaaaatacctagttcttcttcgccttgaccaaatgtaaagtgtcccgcataattatctacgttttttgtttcgtagccatctcgctcagccatctcaaggaaaaattccaaggcttttacaggtccaggaccaaatggatgctctgcatcagcttgtgaatcatcacgctccgagttaatgcgaagaagatttattaaatcgtccatcaaagcgtctttgcgtttgtctacttctgctctaaaatcaattgtcattacggcaactccttctataaaatattatgtagtttgtgcttaaaaattaacgtttttcaataatatgatcaactggcaaacgataactaggttcaaccttttcatcactataaccaacagtaattaatatttctggtctaaaacgtttatctatctctaagacatcattagtaatcgctttatcgaaccctaaaatcatattagaactaataccttgatctgtcaaggcaagtactaaattcatagcaacgatacctgcatttaaagagagatactctccagtttgtttttcactatataaagcatagcgtggtggtagagtttccatgtaataaccaattaaatcatcaggaagagatctacgaccaatacgagctattttccgtgatctctgtcctaaatctgtatctgtaaataaagcaataacatactgcgcttgattaatttggttacaattactttccggtaaaccttctgctagagcagattttttttcttggacaacgacaaacttccaaggctgaatattattagcagatggcgctaatgtcgcaatttcaatagcagttctaacatctttaaagtcgactggtttatcattaaaatgtttcacagcatggcgcttcttatttaattctagaaatttcataaaaacctcctattctatttgattttccctactattctatcactttttaaaatgcgtttcagcttttgaaggcaaaattgataaaaaagtgaaaccggtttgaaaactaccataaaaaacaaacaaacttgtggtacaatatctaatgactataaaaaaggagctattcatgctacgagcattaaaagaagatttttttctaaccttaacctctttaaaaaatcaattttgggtttacattggaactggtatcttaatccaaactttagttgcttatttagtaaaaggaattctgagttttatctttcgtcggatattgatattgtcaaatactcccgcagtgactaaagacaattggactttactttttaatcatcccttagctttattactctttatactttatatcgtaatcctaattgggttcatctatactgagttcgctatctatactattgccatactgaaaactgaattttctctcagtatcaaaaaatggctaacaatctttcctaaaaaaataaaatcacttttaggaccacagctaatttgggtatcaatctacttacttttgacaattcctctagctaaccttggtctaaggtcaagtatactagagcatcttaaaattcctgactttatttctggcgagttaacaaagacagtctttggaaagataggttactctacccttttactgcttatttgttacttaaacctttgattaatttattttctcccgctgaccattttaactgactacaatgctaaagaagcacttttagagagttggaaacttagccgcggaaagcatcagtggcgtcttctaagtaaaattattttaaccagtttatttatatctgtaattggaacagttgcactagctgttgttgctggtacattttcattcattgatcattctggaaacaattttcctcttcaagccactttctataaccttttaaaatcaatactttttgccgtaacacttcttattaaatgtttaatcataagtcacctattagcagatattaaacaaaataaaagtattgttcaacaatggagagcttggaaaggcgtccaacataagcaaaaatttaaacacattgcttgtgttatcctagctctagctattggtaccactgccttaaaaaatgctatagctctggctctcctacaagataacatttcaattaaaaaagaattaatagcccatcgtggtgatacatcacatggcgttgaaaattctattgaagcattaaaagcagcccataaagcaaaagcagattattcagagatggatgttatcatgacaaaagatcataaattagtagtcatccatgatgataatctcaaacgactctctggtatgaacaaagatgtttctaaactaactttagatcaagttacaaaaatcccaattcaccaagggcgttttgctagtcacattccatcatttacagaatttatgaagaccgctcagtcactagatcaaaaaatcatgattgaattgaaaccgtataatcaaaacctcgatatctatgcggatgaatttatcaaagaatttaaagagcttcgtctctcaaccaagcataaagtaatgtctctcaacttgacactcattgaaaaagttgagaaaaaattgccacaacttgatacaggttacctaatcccactacattggggaacgcttcaaaatcataacgttgacttttatgggattgaggaattttcatacaatgattggattgcatatctcgcccaagaatataataaacagctctatgtttggactattaaccgtgataaccttatgatacgttatttacaaagcccagttaatggaatcatcacagatgaactcaaccttttcaaggtcattaataaagatatcaaaaatagccctaattattatcaaagagctctccaacttattgatagcgagggttaaattaaataaaaagcttagtagaacagtatctactaagttttttatttaggaggatcattaagagaatctcggagactttctgcaacagtcctaggaataccacacataataatgtcctcaatctcagctttttggatattaggtaagcttttaaaatgtttcattagcaattgtttacgttttggtcccaacccagtgataccatctaattttgaagaaaaggaatttttggagcgtaattgacgatgaaaagtaatagcaaaacgatgtacctcatcttgaatacggtgaagtaagaaaaattcttctgaattacgcggtagctctactacttctaaaggatctccaaaaagtaattcatgtgtttggtgtttatcattcttttgcaaacctgcaataggtatggctaaaccaaattggttctcaataacatcacgcgctatatttacttgcccctgaccaccatcaattacaatcaagtccggaggtgtcaagccatcttttaaaaccctactataacgccgatgaatgacttctctcatactagcataatcatctggtccgataacagtcttaattttaaactttcgatagtcttttttacttggctttccattcacaaataccaccatagcagctactggacttgtcccttgaatattggaattatcaaatgcttctatgcgtactggtttagggatattaagaagattacctaaattttcaattgccccatgagttttacgaatatctttttccagtaagtcaaacttctgttgtaaactgacacgagcattttttattgccagatttactaactgtttcttttcaccacgttgtggtttaacaatcttacagcctacaattgtttcaaccgacttagcatcaatatcctgtggaataaagacttctttgggtagaaaatgttttgtatcttgataaaattgccctatgtaagttagaaaatcttcctctggttcattataataaggaaacatattcacgtcacgctgaatcaattttccatttcgaacaaaaaagacctgtacacacatccaacccttatcaacgaaataaccaaaaacatctctatccttcatatcttgatgaataacacgctgcttagtacgcaacaaactaattgcttcgatcaaatctcgatattcagccgcacgctcaaattccatagtcatagcagcgctcttcattttttcagttaatccgttaacaattttattatctttaccattaagaaactgttttacatcttctctcagactatcccaataagctttattagtttgacaaactgtatgtgcattgcattgccctaaatgataataaaagcatactttatttgctggattagtacatttcttaaaaggaaagagcctatctagtaaccgcttaatctcagttgctgccccagaatccggataaggtccaaaataagtgccatctgatttttttacttgacgtgtaatcataagacgaggataacgttcatttgttattttgatatatgggtaagacttatcatctttcaatcgaatattatacttcggcatattttcttggattaaattaatttccaataatagagcttcggtattagatgttgtcacaatgtattcaaagtcttcaatctcagagaccaaaagttctgtcttagtattatgactcccatgaaaataacttttcacacgattcttaagatttttagccttacctacataaataattgtcccattcttatctttatgaaggtaacaaccaggactgtctggtaacaattctagcttatgtttaatcagttcattcatagaactattataacaaaatgtactgtaatctttacgaaataaatactattccccaacatctattgtatcttccaatacttgaataaaaccccaatactcctagtctaagcaattattttatgttacactttaaacaagtgaattattgaggagtttttatgatagacgttgagaatattcttgaaaaaatgaaacctaaccaaaaaatcaattacgattgggtcatgcaacaaatggttaagcagtggcaagctagtgatatccgtccgaaaattctgatgcatgtttgctgtgctccttgtagtacatatacccttgaatacttatcacaatgggcagatgttaccatctattttgctaattcaaatatccatcctaaagatgaatattatcgccgcgaatatgttactcaaaaatttgttcatgatttcaacaaaaatactggatattctgtacaattcttatcagcaccatatgaaccaaatgaatttttcaaaattgttcatgggttagaagaagaacctgaaggtggggatcgttgtaaagtttgctatgatttccgtcttgataagacagcggaaaaagccgttgaactaggttttgattactttggcagtgccctaactattagtcctcacaaaaactctcaaacaatcaatactattggtattgatgtccaaaaaatttatgatactcagtatcttcctagcgaccttaaaaaaaataaaggttaccaacgttccgttgagatgtgtaaagattatgatatctaccgacaatgttactgtgggtgtatcttcggtgctaaagatcaagggataaatcttctccaaatcaaaaaagatgcgaaagctttcgtgagtgataaagacggcaaagaagaatttcctaatatacgcttcacatttaatggcaagtcaatgtaaatgataaaaaaagacttagtaaagaactaagcctttttggtataaatcttgtcaaactttaataatacaacttcttaatcttttgcagacgttggtttagaaatagaccacaaacaaaaatacctgtgattaaaccaatccaataggcaaaaggacctaactggctatttttttctaagataaccgctaatggcaaagcacataaccaataagagcccgcaccgatcataaatggttttgttgtatccttatagcctcgtaaaatcccctgtacaggagctgcataagcatctgcaaactggaaaaagagactataagttaggaattgagctgtaatagcgacaaagtgagggtcactattatacattgctgctacattctcacgaaatagaaataaaaatagtaaggttcctgatgtaatccctaccgctgttaagcgtcctatcctactataagtgtttgcgtcctgaaagcgctctgcccctacttcaaacgatattgtaatagctagagcagtggaaatacttaaaggaaaggcatacattaatgatgaaaaattcatagcagcctgatgtgctgcaataatgattgaagaaaattttgccatgaataagcctactactgcaaaaattgcaacttctgcaaaaatttgtaaaccaatcggtaatcccaatcgaatatcttcaataatcaaaggagcttttattctttccagagtccatatatgatatgttttaatttgaggatgaagtgacatcacaataataataacaataaaaatagcccaataagttaaagaagttccaagacctgcccccgcacctcctagtctaggcataccaaatttaccgtagataagcatataattaaaaaatgaattaaagggtagaattaaaagcatcagatacatagataaccttgttaaccccaatgcatcaaagaatgaacggcaaatgctaaacaacaccagcggcatgattccaatcaacatataatttaaataaccacgaccaactgctagaacttcatcttctaaacccaaactccccaagacaggttgagcaataaattgcatgattaaaaataatattaaggacagtatcaaacctaaatatagaaattgatgaaattctgtgcgaatttgttctttatttcctctacccaaatgttgaccaactactggtactaatgctgaaatcatacctactaataaagcgaaaaacggagtccataaattactagcagttgacacacctgccaaatgtagctgactatactgtccagtcataaccgaatcaataaaagtagctgaaaaattagcaaattgataaatcaatactgggataaataatttcaaaaataaaacaaatttttccttatttgtctgagtttgatacatcttttttctccttttcaccttaatcaatttattttagcttagctaggatactctgtcaatgctatttaaaaaggttgagaaataatcctcaaccccattttagctaagctcagtattgatttgccatgtcataccatatttgtcagtcacatttccataagctggactccacggaactgcttgtagaggcattttaatgttcattgcatctcgagaaagcttattgaataactcttgcgcttcttctacagattccacaattaaagctgctgtcatattttgtccaatttgaaaatcaaaaataggattattgtcagaaagttgcattcgaataccatcaatattaaattgagcgttcataattaaatgttcaagttctggcggacaatctggccaaccctgtgcaaaagttgtgacgtgttctgcttttgtattaaaagcctcttcataaaatgtaatagcttcggccccacgaccattaatattcatataaatttcaattgctttcattaccatacctcacttcatattatccaaccaacgctgcatcagagtttcattttccccttttagggtaaaataagaaccacgtattatacctgcgagttttgacttttgacgagcaaacttaaacttgtccgctaattcaataggaatatccattccatctgataattttaaacctacagctctctttttaggattatctaattcatataaaatattaatggctaaaccatcctcatagaaaacatgtgtccataaaatacgattctctaaaaaaagctgtgaaatctctaaaggctttgcagcaaaaacaaggttacgttcattttttagaaggtgattaatatctgccatcaattctggatagtctgatactggaaatgtttcgtaggctactttgaatttattccagaaatagcgagcttcatttgcacgcaaaccagccaaggcttctgccactggagaagtctccaaacctttagttgaaacggttttaaagtcgataatcatgttctttcctttttgattaaaatcttcgataatttagtatactcttttttgaagaaaaagtacattctaatcacttataaaaagtagtacatttagaacactaccacctcagtaatttcttgacctttctctacttaatacttataattaatctagacttaatgtcaaagcatcaatcaaggtgtaaacctgattcacctaaaaagctgatggagctaaacatgaccaaaaagatattcttatttatctgcgctactcttttagtaggaatagccttatatacaccaacaacttctatttttaatcataacaacgtttatgctgccaccaagaaagcaaaaattaaatttaataaaactcaaaaaaaaattgtcaaaaaagcaagagaatatgctaagtctggccatatgtctaaagatagtatcattgaaaaattaaaaaaggattctaagaaatatcgtcaagaagacatcaactttgtgattaataacctcaaggttgattacaaaaaaaatgccttgatttctgccaaaatttattcaaagaccatgaatttatctaaacaatctatctttgaacagctctattcggagtctccagataaggcaacccactctgataaatttacaaaagaagaatcccaatatgctatagaccatctcaaagtagatttcaaagaaaatgctcttgagactgctaaaagttatcaaagtagttcttctttatccaaagaagaaatctataaacaattgacatctacgctgggcgataaattcacaaatgatgaagcccaatatgctgtagatcatttgaaatgatgacataccaatagtctatccttatgtaatagaattgatagcttatgctaatattccagctgtaaaatagcaagaaccctcctaagtcttaatgaacttaggagggtttttatcaatatgaataggttacactaaactagacagaaattataaagtgttctacacttaagaaaaactggagaaaaaccatgtctagaaaagtacgtcgtcacttcaccgatgattttaagcaacaaattgttgacctttacaatgttggtagaaagcgtagcagtctcatcaaggtatatgagctaaccccttccaccttcgataagtgggttagacaagccaaaacaactggttcattcaagtctattgataatctgacagatgaacagcgggagctaattgaactcagaaaacacaataaagaactcgaaatgcaattagatatcctaaagcaagcagcggtgattatggcacaaaaagggaaataatcactgctaataaggataaatacagcatttcaaagatgtgtcgctggctgaatatgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtggcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcctagaaaaacactttataaatgttgtacagaaaagtgttgccttttcacttaataaaagaaagattgaaggaacacttctctttcattccgaccaagggtcacaatttaagtccggggaatttagaaaaataattgatgacaacaataggcactgaatccctaaaatgagacaaaagaaaaacactcctgttgaaatttagtaaactagaaacaggagtgttttattatggttaaaaaagcatattcatgggaaactaagctggcttgcatcgatatgaagaaagcaggcaagtctaacagagttattatggagactttaggcatcaaaaataatagtcaaatctatacttggatgaaatggtacgaaaacgaggagctttatcgttttcatcaaggtgttggcaagcaatatacctacggtaaaggcttggaacatctgtctgaagtggaacaattacaattacaggttgacctcttaaaaaagtatcgaggcttgataaggaaatcgataaagtaagtcttatcaagcttgtggaagactataaaaacaactacccgatagttttcattctagactgttttaaggtcaagcggtcgacctattaccgttggaaaaaggagtatgagaagccgcaaaaaaagatgaccttattgaattaattgaacagctctgtatggagaatcactttatttatggctatcgtaccattacacgattgctcaaaaaaatccacggattgactgttaatacaaagaaagtctatcgtatcatgaaaaataatggctggctttgtcggacacgtaccaagaaagttcccaatttgggtaaagcttattatttaacagataataaattgagtcgggatttccatgccgataagcctaaggaaaagctcgtaacagatattacctacctatatttcggtaactgtaaattgtatctctcatcaattatggatctctataaccgagaaattatagcttacactatctcagattgtcaggacacggattttgtactagacacccttaatcagttaaaattgcctaaataaaggagcaatcttacacagtgaccaaggctcagtgtatacttctatggcttactaccaggcttgcacggaaaaagacattatccgctcaatgtctcgaaaaggaacacctgcagataatgcctgtattgaatggtttcacaccgtcctaaagactgaaaccttttatttccataataggagaaaatacaacaaagatagtataacaaatattgttaaaaattacattacattttataatgaaactagaattcaacagagattaaacgaccagtcgcctgtacagtacagaaaactgattgcctaaaagtgtttttcttgcgtctcactattagggtgcagtgccaatatcatgcattctttttctaatcctggatatccttatgataatgccgtaactgaagcatttttcaagtatttaaagcatagacaaatcaaccgaaaacattatcaaaatatcaaacaggttcaattagactgctttgaatacattgagaatttttataacaattacaacccacatacggctaatctaggactaacccctaatcagaaagaagaaaattattttaacgcaataaaataacacagttttctgtctacttatttgacattagtccaagaatcctcctctttttttactattctaacatggataccatttctttgcaaaagaaaaccgctattatccaacttttatcactactcgttacatagaatgacttcaaaatcaccgtaacttgctttgacaaagcagtgctttaacaatgagatcttcttttggttaagggtttatttgttgaagtgtcttgatatcataagttaccaattcaccatttttattataaaattggacaccttctggttggaaaatgagatacttaggatcgatattagctttttgtgctaattgattgatatgatcttctagggttgctctatctagaccatagtctggtaaactgtctataaagtcatctgattctttttcttctttactggcttcacttggctgttggttttcattgctcttatctgcctgttgcttttcttcaggtttatccgtatcagtagcatcaccagcatttttctttgccaataactcttgagcttgttgccactcagcttgggatagatcagatttattaatggttctcaatgaactgccatctgctcttgggatgctaaaggagccatctttccatacaaaagtttcttttgccaaaacatctcgtggatcgaaaatatagccgtctggtgctgcaaaacgaccttctgctagggctttttgaacttcttcagcagaatggataatttgccagtttggcataccagcacgtttatcaagaggcgtaacatttggaatgaccgaacctgactcttcatgccctggcttagaccatacatccggacgaacttcggggtgttgcatcacatacttgattgttgcaatctgattgcgcgtcaaccatgaatacggaacgacatggatatgatcaatatgtgggataacaaacgaacttccagtatcgtaagtagcattaccagcatgcatcggcagacttgacaaatctacagcaagtcgtggctcaatgcctgtatcaacaatgtcataacggtaatgcttcttatctttaagcattagttcttgttcggcaaaggcaatctgagtcaaatcaagttgataacgagcatagaaatagtccttgccatcttttggcataatatagcccactttaccatcttttgttactttgcgactcacttttttagtgtcaaagagtggtttttctttgccttgttcctgatccaaagcagcaacaagctcatcagcttgaccttttgctttcacccagttagcgacctcatccaactcatattgttcaagttctccaaatcctatataatggaaatgatctccgtgtttagctgtaactcctgatttatccactgaatgaatggattctttactaaaaacataagcatcactcgtatcatatggtttaccatctaagccttttccgtaagctttgatgcgatgaccaagaaaggtatgtgtcacttctttatctgatggttttgagtgatctgaacctgagtcgttgtcatcagtttggccggctaagtatcgatctgctaattccatttcaagaggtgataactgacttcttgggataatatgataatgatctccatgaggcaccacatacccaaaagcgtttgatttgatcacttgagtcggttcaaaaatcaacccatcttcttccacatgacggtatttcaaatcaagacggtgtagttgatctaaaagttccttaaaggtttttcctttaaactcatctctttggtgtttgttttgtgacgcatcatttggcctaggaggcgctggatgataaccaccgttatctggctgatgaccttgtccagggttaggcgtcacatcaggaattggggctttcctacgacctggggctggtgtcgggcggtaatcagacggtctagcacctcgaccttgtttttgactccagtaggcttgtgcagcagctagctcacttggagacaaatcttttttaggaatataatgatagtgattaccatgaggtactaaataagcatctcctaaatcatcaatgatatctgtcggactaaaaatatagccatcgtctgtagtatagcgtccttgtctttttgcttcattgactgccgcaacttcttctttactgagatgggccacttgagctaaacctttttctttagcttctttagttcctttggctacttgctcagcaatttgttgtttggttcgaatgtttttgcgcttactacctggcttgaggtaaacataatagttgccattgactttaataacgtaaccgtctaagatttcattgataacgtctgattgtttaaaatggtaattaggatccgtcatcaacaactcttcactaataatcgcatcataaggaactttcccattgtaaaaatgataatggtcaccgtgtgaggtaacataaccttggtcagtaattttgactacgatctgttcagcagagatgccttcttcagcactgatttgatccatcgttttgtttgttttaggggcttttaccttacctttgctatcatcaatataggcaatctgattgtcctttgttgctagacccatatgatgcttaccaagctggtaacttccaatatgagtagctagtaaaatagcagcaactgagccgatataaccatatgttttcttcactaataatctcctttacttcaactgttgatagagcacttccaaatttgctctaagattttctagatatgtcttgtttccgcttggagcagcttcaagtggacttaatgtctttactttagctcctgttgatttcgcaatagcatgagcaattttggggttgacgttgtcttctgcaaaaatagtcttgacgttgtattctttaacaaagtcttgaatttctttcaattggcgaggagagggctcttgctctggagaaatacccgagataccaagttgtttcaagccgaatcgtttagccagataagaaaatgccgtgtgttgcgtcacaaatgtttttgagcgcacctttttaaatttttgagtgtattcttcagttagttgctctgcttcttttttgaaagccttagcctttttagtgtaactgtctttgtgtttaggatccaaatgtcctagctctttagcgatattaacagcttcctcaccagctaaaacgggatccgtccaggtatgtgggtcataaagtgtcgcagggtcaatgccttgtgtgacttccatatcttctagccctttgactctatctagtgtcagaggttttgacgcttcaaacacattaacctttgatttttttaaattagggtctagatcccttgcccaagcttctaaggtatgtgaatggtaaacaaacaaatccgcgtcataaatagctgccacatcatttacagacggttcaaaggaatgaatgcctgcacctgattggatcatcctcacatcatttaggtctccagatacttcttttgtcatcgcatacattgggtaaaagctggttacaactgacatgccttgcgtaggctgtttggggtttgctgacttatcacaccctgctatcattactaaactcacaaccatagccatgagaaaaaaaacttttttcatagtacctcctcaattataatttaaccagttattaaccagttaattttactcctttatcaatgctttgtcaatgacaactaccatcttttatcacatcaactgaagggataagcaaaaggcaattgttgacagctatttgtcctaacttctttttgatgaggtagcacaatcgagtagaggctaatctctagcccctctcacaccaccgtacgtgccgttcggcatacggcggttcaactaacttttaacgcatgtcgttcaagatagtaatctaagcaactgaccagtcctcgctttgcgagggctggttttgatatagcacgtttgagtaccgacttctgagctaccaactgatagtggtcaccccatccagaaactttatcggctatccatctagcaactcctagttttaagagtccccataggcgctttgctttcttcttccattgcttccagataatcactcgaatacgggttcgcagacgctcatctatttgtgtcatgatactcttcatattgccaagcgagaaatagtttatccatcctcgaatgacccagttcaatcgttcaatgcgagttatcaggtcaatgctccatttcctcatcgtcagttgcttcagttttcgcttaaagctctgaacgctgtcttggtgaggacgacacttccaaccttttggagatttccagaaaccaaatccgaggtatttgagtttgttcggtctgacaatcttggtcttagtcatgttgactttcaaccctaatcgcttctcaatatagctactgaccgaatgcatgacccgcttagcagctgcttcgcttccgacagtgatgacacagtcatcggcgtaacggacaaagcgaagacctcgcttttccaaccctttgtctaactcattaagcataatattagataggaggggtgatagattcccgccttgaggtgtcccgactaaagtcttatgtcgctgtccgttaataacaactcccgaatggaggtacttacgaatcagtgactccgtatcgccatcttgaatgatattatgaaccagggacatcaatctgtcttgcggaacagtatcgaagaacttttccaagtcaatgtccacaatccactcgtagccatcgtttaaatactcaagtagctgaacaatggctgtttcgcaggagcgattgggtctgaacccatagctatactctgaaaaatgtttttcgcagagtggactcaaaacttgaacgatggcctgctgaatcattctatccatagccgtcgggatacctaggttacgaactcctccgtttggttttgggatttcaaccctgagaaccggttgaggtttatagctcctctctttgatgagttgcttggtttctcgccaattttggtgaagatagtcatccatctgctcgatagtgaccccattgataccagcagaacctttgtttgatttcacttgcttgtaagcttcgagcatattgttccgagataatatcttatctagcaattctgacatgtgcgtattcctttcttttttcgttgtctgcatgatatcttacattggtgaaccttcctctagtcaatacgtaaccgcatctagttctatcagaccgtttgttttacagacacaagtgaagtaggattacttcgattagttgttcaccccttcgttccatttccattacagaaacttcatcactactatgggttcggctgacttcttgtcgttcgttgttattaggttttaccctcgacaggacctcacgggataagtcggacatctttcctcgtttactctcgtgatttacgtatataggttacgactacctatttggactttagagtttatagccccctcatccgctatatacgccttcatatcacgtttctgttcgtagagccacgatttcgctatcccttcctctccccgctacctcacgatagtcaggcttgggagtcgctattgggttcaccggtagcgggtgcccacagaggacttgcatctcagatgtacgacatgcccgtcgtactataaaaaaatagagagaaccaaattggttctctctattaaataagctcttatcagtttaagtaatactattttttagtttctttttggcgttttgttttaaatatatgagctgctaatcccaagaagaaagtggtcataactaacttaaggagatgtaaacgatttgtatccttgtcattagtcgttggtaactgatctcttgttgatgcttttgtagctaaagcacgcttagaagatcgtttctctagagtacgagaagattgacctttttgaggagttttacctggtgtttgacctgaactatctttttctggtttagtttcttttttttatctggtgtttgacctgaaccgtcttgttctggtttagcttctggttttttgtctggtgcttgatctgaaccgtcttgttctggcttattagagtggccctccaatagcttagtcactggtgtataagtgatgttaccagccatatcttcaacaacataagtaaagtctgacattttcaatggaacagtagcgccttccattgtttcagcctcttcaggaagagtaaaggtaccatcttcatttggagaaatatactctgttgttggcagatcctcatccatataagtgtaagcaatacgctcacggtaaaccggttggctggtttttggtttagatgcaagtgtcaaacgactatcttctgttgagaatgttgccgatgttgcgacttcaggtgtcgtattgtctacaatcacatcaaaatcagtgtgttgttcttttgcacctgagctaatcggcgtgtagcgaacacgataggtgtaggttccgttagcaacaactttgccgtctttatttttaccgtcccaacgcgttttttcaaaacgggttgaaccaagtgtgcttgccaagtcattgttgtagtttttaacaacttgctcggttacctcacttgtccaaacaacatttccttctttgtccaagacttcagccacaaggtttttagcattacgcaagaaagtaccttggaattggacataatctctgttaccgtccccatttggagagatcgcagcatatggtttgccattagcgtgacggtggatatagtagtggctatcatcgtcttgttttgcaaaagtacctgcaaaaatggtttctgtgatctctgaagattcgatatcctctatgttttcaaccccttctttgacagctttaataatcgtccatgggttagactctgtggtaagtgctgtaaagttatttttcagagcgtaaaactgtaatccatcaccatctaattggtctttggcatcactatttgcttcatgatagtagctgctaccgtctttgctatcatagattggtttttctaaggctgacagattgccaaaatcacctcggaaaccaatatatggaatgctcataagctcttcttttgtaggatcttgtttgaaacgaacaaaaccttctaagaaatagccatttttcatttgggcaagcaagtccttgctaaatcgactagcatcgattggaacggtgacttgtttgctgctattggctggaattgtgattttttgccatgatgtctcatacaatgctttaggagccaaggcaaagtgttttccatctactttatctgtttgaacagttacttggtaatacaactcttgaggtttatcagatttgttgtgaactgttactgttacttcaaatttatcagaaacattgttcaggtgaaccttgcttgaggtattgtccttatctgttacatacatcgttgctgctgaagcttttttagcatcgactgctcctgctccctgttggcgaggagaaaaataagctttttcatcttcatcatatagggcagttgctgagctcatcaatactttcttagctaaatcaagacgctctgatggtgtcatatcaggatactgtgtctcatattgcttttgcaacagtcccatgatacccgctaccaatggtgcagacatactagttccagaaagtttggcatacttgttgttagccactgatgacaaaatatcttggccgggtgctgcaatatccggcttaatattgccgtcagctgtcagaccccagcttgagaagcggcttagtttggtgccacttgctgttggcaataccttaggtgtcgcattgaaggtaatggttttttggggattgtcttttaataagagaccgtctcttcgactgataaaggccgcaggcatctggtcaacatttggcaattcaatcgggaagcccttgtcttgattgtcatagatcaagacccctacagcaccagcttttttagcgtttgcaatcttatctttgaaatcaatatcgccacgttcaataagggcaatcttaccttcgacatccttaaaatcatcctctttcgtaccacgattagcataagcatagtcgtaagccttgtttggctcaaaacggtttgttgaaagaacaggcatttctttatcttgatgatcgtctgttttgaccgtagcagtttcagtgagctgtttatctgggctgtaagaagcaactgtcaatgttgaatctgccgctgcaggtgtcccaaccaccccataatcaggatgatctgctagaggtagacggggcttgcccccaaagctactatcattaccagctgaggtcacaatgctaacaccttttgatttggcatagtcaaaggcttttttggtttcgtctggaaggttggcgtaagctagtgcagcattaccaaagctcatattaatcaccttagctcccaagttgacagcatctctgatagcttgagcgtagttacgagcatagtctgctagtccatttacaatttcgacacgcatcaaaagcaattgagcctcaggcatcgcaccttctaggcggtaaggttctttcatttcagatggagcatttcctgacaagatccctgacacgtgtgtgccgtgttcttgatcaacagcgtttttaccatctttactatagtcgtggtaataagcaaccttatcattgacccactcgccataggtaataccgtgctcttttttagctttttcaagattttcttttgattggtaacgtgctttagttttgtctgttaagcgccacgcttcatgatttttatcaaaaccagcatcaatcactgcaacaacggtcccaactcccttgcctgctttttcctgcagggttttgacatgagaagggtcgttcaaatccctaatagtcgcttttgaggttgctggtgtatcagcagttttagcaggagcttgaggggctagatcattagcgtcatctgctactgtttctcctacatcactaggagtttgtgaggttttagtttcctttgatgatggtgattcctcagaaactgctattggttgtgggggttctacggcttgttcggtagcaggagtgtcttctgtcacagtatttgctttaatgtctgattgtgcattgagcaagatgctcgtagatataagcgcaatggcaagtttatcaaatggtagtttttgttttttacgcaatgtgtcgtcctttcatgatgagagactttgtctttatgaccattaagaaaagagagaatcaaacgattctctcctagctatccgtctgtgtgtagagaaataaggataacgtcttttttaaagagcaaacaggggttatttgcatatgacacagctatttttcttgcttttgccataatgattaaatgtatctcatttatcaattatattactaacatctttattataaaacaaagacgattattagtaaaggtcatctttttaagagttgtttagtttgtgacctccttaacctcattcttttagacataaaagagagaaccgatcggttctctcttgatgttcactcaggtatgtgtctgaaattttgagattagtcgatacctcataaatttaagaaaacttgaattattcttaaaaagaccaaaacaagtattttttgcttgttcagtcttgacggtattgttttagttatgctacaataaggttcgactgattaagcaagtggtatttgtcttaatcggtttggtgtaggagttcgcgctccttcaccttttttgcttttctttaatataattatactactttagaagatttaatgcaagttaaaacatgcaaaaaaacgctagaaataaaggtatctttagactttttctattttgttttgattcctgttatactccattttctgccattttttagaaggggcttagaaaatttatctaattcatctgtctttttaaaaagtcgccctgcactaaatgaaccttctttatactcactgtatacctttctccaagaaccgaaaaataattctcgtaaaccgttagctctttcaagtataatcatatttgccattgtggagattccccactttgaccaatacatgccacgtcgcttcattctatacgttatctttctgtgttgtgattccatgataccaataccacgatttgaaagatttctaagatgagctggttttatatatttgaaattatttaatacttttttcttaaacttctgaaattcttgatcttcaagttcatcacaaatcagtgattcaacagtatcaaaaactaattcaagcttatcagaattatatttttttaccgcatctaaagcaaaatcggttaattcaattggatattttctaaggtatgaacttaacttttctttaacatgatagatatcccaaaaatgctcatgtttctttaccttaagtgcttttcctaattccttaaaaactctactagtatagcctttacccatatcagagttagtgattaaaatagtatcgtcatctacttcatagttattataaatataatctaaaagattatatttagctttatcataattaagctgtaatatttcgtgcttgtcccgcaattcatatcttttagtagaaactttttttgagcctgtatgaataacaaaatgtgttaaatctaaataccttctttcctctctagaatctgtgcttttaatcatgactccatcaccctcaacatacagttttttcacttttttacgttcgggtggctcttccaaataaaaacgatagcgttctttttcttttaacaatttttctacaaattttactgcttttaaaacacagtcttttgttatgattgtttgcaaagtgctatctattactttgcaaacttgacgataaggcatcattgtagccaattttgcaacatgatataagaattctattgaatatctcttatatttttcaagacctaaccactcatctactggtattctagtttcaaagccatttgtccagcgactcctactaaatgttatttctccaaaagagaaaacaaccgtacgttcagactgattgatcctcttatagcctttcgttctcatttgaggagcgatatagctttcatactgttcaatttgacttaaaaattgtttctgttttattttatttatttcatttacaaaatctttttccgagaattttttaacttccatgataatattttacaatttttgttacaggattagaatattattgctattttttattcgaaaagttaaagtaaaagaccacatttaataacgtgatctttctatttatcctactgtgcaggctcaaatccatctaatccaatgaatgactgaaacttgccagtacctgaatttgaagccgtgccacttaaactttgaacatcatattcatcttttggctcagaccattctgcatgaatataattagaatcatctgtgtcatcttttttccagtacaaatcagtattgtactgattgtcaacgtaattaacccaaattgtatcaggctttccaaaaatttcaataatatcttttaaagatttatcacctttttcaaaagtttgattgatgttttcaacagtaaaattattataattacctgatactgatgataaatcccccctaaaatcaacctttgaataatccatttcttttatataatcactcgggtttaatcctaacgtttttatataatcttctgctcgttcttcatcagtttttttgtgtttaacgacttttgcacttgtcgcaccactaggatttgtcttattctttttagaagtattactgctttcagaacctgtaaataaatttataacactactaacaataattatcactattattaaacttaaacatccaccacaaccactttttttctttacttttttcttaaccatttttcccatctaataatgatttccataataaatataattcaaactttgtttacaaatttttaaaaaagtcatttataaaagatgatgctgaacgatagcctttttcttttgatagcctatcaattttttttcggactgaaggttgaagtgtaaattgatattgttttgtacgttcaaagtccctaatattcatttcagatgagaaaatttctttcttttcttcatctaaactttcttttagaacttttgttagttccgaattttttggttcaaatgccatattcatcctctttcttataaacatagtcatatttatgtatataactatgtttatatttgtaattatatttatagtttatcagtaattttcctaaatgtaaaatcaatttctttgaagaatttactatctcttgaatataattctttatcagacatcatataagatagagactttttgtccaatgttgagcggttaaataactctttatgaggaatcattgcaagaactgatttatcattctttagtgatcttattaattcttttgaagagttggtattatgctttatcatattacctaaaaagaataattttgctgtgacataacttgctcgagttttaaagtcaaatgcctctgttttaaattcttcaagtctttcagaaagatggatgtatactataaaagtagacaaaactttgtgtgttacaatctgttttaaaagacacaaaaacgaaaggacaacctatgtcaacatttaaacgctatgatgaagaattcaaacaatctcttgttaacctttatcaaactggaaaaactcagtctgaactctgtaaagactatggggtatccacttctacgcttgcaaaatggatcaaacagtattcccaagtcaaactcgaagataattctgtacttactgccaagcaaatacaagagttacaaaaacgtaatgcgcagcttgaagaggagaaccttatcctaaaaaaagcaagtgccatattcatgcaaaacttaaagtaagactcctcgctgtctatcggttacgctttgaacacgccacaacaaccttgtgtcgtgttttacgtgtcaatcgctccacttactataaatttctaaaacataagccctcaaaaagagaattggataatcaaatttatagaaaacaaatacttgagatttataccaaagcgaacaaaagacttggtgtgaagtctatcaaggtcattcttcaaagagactatgacacaaaaatctctgaaggaagaatttgaataggttacactaaactagacagaaattataaagtgttctacacttaagaaaaactggagaaaaaccatgtctagaaaagtacgtcgtcacttcaccgatgattttaagcaacaaattgttgacctttacaatgttggtagaaagcgtagcagtctcatcaaggtatatgagctaaccccttccaccttcgataagtgggttagacaagccaaaacaactggttcattcaagtctattgataatctgacagatgaacagcgggagctaattgaactcagaaaacacaataaagaactcgaaatgcaattagatatcctaaagcaagcagtggtgattatggcacaaaaagggaaataatcactgctaataaggataaatacagcatttcaaagatgtgtcgctggctgaatatgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtagcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcctagaaaaacactttataaatgttgtacagaaaagtgttgccttttcaatctttttaaataaattttctataacaaataatctaataatgaattataatatatttagattatttaggagacttaagaaatggtaaaccaattaataattttaggaaatggatttgatagagcttcggatttgatagagcttcggatttaaagtcaggatatatggattttttcaattttagatttaaagattcagacagtactagtagtttttggtattatattttgagatcatgttataataaaaaattgtctagcgatttatggagtgatattgagaaattaatttcagtacatctaaaaaacattataacactatataataacgaaacaattttaagtggcaaagatattgagagtatatatatcgaaacattaagcactgattactcaagaaatgattactctaccagtgaggagctaacgcaaaaagcactccataattttttgtggaatcataatggtatacctattgttccagaactagataatttattattactaattcaaaaagatttaaaaatagtcgaagatgagttttgttcttatttaactaatcaaatagagatccaggaacaatcaaaagatgattattttaaagatataactaatttgggaaataattacttattaaaatctcgaattatttttgaactcttgtataaaagtaatatttctagtgcattcacatgtaattcttttgttgcactacatgattttcataacgaaaattgtttcaattcctatgaaggatttcttagctacatttatgacttagaaagtaataatgaatttaatgttgaaacatcaatattgaattttaattatacattacctagaatagataaattacaacgtaatattcatggaaccctgaatgataaaaatattatttttggaatagattatgattctttaattgatatacaaaaagataaaaatgttaccctgcctgttgaatttaccaaatcatacaggatattacagaacggaaatatatttcaatatccaattccctctgaactaacttttataaaattttatggtcatggtctgggtgaagcagactattcttattttcaatcaatttttgactcaattaatctttattccagtgacactgtactaattttctattggagttgttataacgagaatattagggaacaaattaaatctcaacaagttcatgcagtacataaattaattgaaaaatatggagatacttttaataataagaatcatggcagaaatttattcacaaaacttcaattagaaaatcgtttaattattcaagaaatactttataatgatattctaaatccatattaaacaaaacacccccacaaaatattgtgggggtgtttgtggggaagattcaattgaatctttccttttttaatcgccttaactttaacgaaaagactttaaaactaggctttcacctttaaacaaccaatagatgattatttaagagtaacaattgcacaacctgttaaatgtgcaatatcaaggggtttgagttcttaatttgaagtttggcaggaattttggcataaaattgaatccaatcctgcacttttgatattttgtgtgatttcttcagaaactgttttatctaaagcattaaaccagtgactgtaagtattcaaagttgttgatttatcggcatgtcccatacgtctggctacatataaaatatcttttttcaagacattgattagataggatgcatggctatgtctgagaccttttcctgtaattactggaactcctacctgttgagctttccgtttgatgatgcgacaaatggttgatttgcaaaaaggatctccaaatcttgaaatgataaaatctgtatcttgatttgcaaactgattttttcgccaaacttgaagtacttcaatagtaatatcatccaattcaataagtcgttcacctgctggagtctttgtttggtctttacgataccaattaccattttcatctttctctaaggttgtatgtacctttagaaattttttatcaaaatcaatatcctcccaacataaagataaaccttcgctcactcgtacacctgtcatataatataaccagatggcagtaaatcgttgcaattcttcataatcatgtaagtcaaatgatttgataaatgtctgaaactccgcataggtccaaaatggagtttctggatgtttacctctaggattatctaatgctttacaaggcatatttgaaatatagccaagtctttctgcataacccatacaagctttaaaccttgaccataaatttttcgcatagttttcagaataattctctatgatatgcaatctaaaagcttcgcaatctctaggagttattgcttttaatggctttaaaccaaaatattgaataaaaagtttatgatgaggaagagccgtcttatatgtcacagactgaaccttttgcttatatgctcttaaataaattttgttcatatagttttcaaaagtcatattgtaattttctaaactgactttgttggcaaattcatattttatacgaactaattcgtcatatgcttctttcattgtttcaaaggttttaccatattgattttttctagctttcttttgtacccttttgccagttactgggtcgattccaagatcaatctgataaaatatctttcccttattatcacaataaacacctttgtattttttactactttttgttgccatttggattctcactttctaaatgttatttagatagtggaatccctattaattgttccacaatttctgctggtgcgatacctagtcttcgattgtcaaagggcgatttacttaattgtaccgcattatggtcaactttgcgagcttcttcaaacttttttacagcaatttttttagcttcacgaataatgtctctagaggtatgttcaggaaatcctaagttcattaaatctttatatgtagcagttctcatacactttcctccttcaaatcactaagttattttacacgctagatgggatttgaatggttagttcaatcatgggaatttcacccgctgtcctttttcgatggcagcctgaacggtcagaagtatcattatcattatttgtgttatggcagataggtcaccatcctatttttgaataaatgattttcgctcatttcctggcgcattacattctattgctcaacaaataaataaagtcccacctagaattattcaattgtcaatgaacaaatcaggagggactattttaaattattctttattcggtggggaaagtcagtttgccccaacaaataatctgtactaacgttatatagatttgaaagttttattattacatctgccgataaaatacgttctcctctctcaatttttgaataagcagagtgggtaaacgaaagcttttcggcaacgtatttttgagtgaaatcattgtcttctctcaaatcccttaaacgtcggtacatcaatctttctcctaaggaaaagtatagaggataactaggagaaatttgatatattgtcctaattggacaatagaaataaaactcccaaaccgtttatttctttacaaattagacggtttgagagtagctttattatacattatacaaaaataaacaagaatatgttggaaatttgaacatttattcaatatgaatggaaaaatcgtctgtcttgtatttatccatatttaaaactcttacatattcatccaactttctaaccgcattttcgtattcttcgattttattgtctagctgattctgtatcatttcaatctcagattcaatctgtccaattgttacattctgcgataaattcatcttggaacattcatacttagctaattgcttggtatcttgattatcactttgtaggttaacaactacttctgccatcttgtttaaggtggtgtttttgtcttgaagatttgtcaattcaatatctagctgtgcgatgtctccaaccaattcatcttttaattctagaaaggatttattttgaatgtttaatgtcatcaataaattgatttcttcaattttttgttgaagactgaccagacttattcgtctcttataaggtaaagacttattgtcaaacgttagttggcgaatcaagtcccttcctttcataaatcgattcatttctgagtcctctttatgataaatgaaataagaagatgtttctcgaataaacacctgatactgcttcttattttcttgttctaagatattaagttgatgatttggaatgaagattagtccttcttgtccaatacccatccaaactttaacaaatagaccatctagcacaattttttcaatttgctcctccgtgatctcaacttcaaactcatgtacagcatctctcttagttttatacgtttcataagcttcggttatttcttctacagtcaatatttctgaaagctgttgtgtctcaaacttttcaaattctatttttacttcattattatgaagcacttcaaacacatcatgttccttgaaataactatcaaaatacgtagtatcataaagatttttctttcttaatgacttatttggtatggaaatgcagctttttccatcagaaagaacaaaatctatcgtttttttcttgctcttcaattctaatcccagtaaccgagctttctcaactaaatcatcaaatgagttggatcttagcaataaaaattctaaaatcagttcaatctttttcttggcaaagtaacgttgaaaatattcttttgaatagggttctctcttattcagcttatctccttggatgacttgcttcatatttctatctgtcataaaaaatcggctatgtttccttgagaaatctattttgacatttagttgctcagctttttgcataaaatcattgaaatcaattgaatgttccatgagaaaaaataaccgctgcttcaattcgtatttgtgattagaacgtcgatagacctcataatctctatgagaataacgtttaggtggaatgattttagcacccgctactttagaaattctatccgaaatcatttgtaaatttctttcaagagcgtagtcccacttcaactttttttgagattggctattgattgagttgataataatgtgattatgacaatggtcctgatcaacatgagtggcaacaatgaatttatattgaccacctatcaactcttttatcgtttcatagccaatacgattgatttcctctgggcttaatttatcttcaggtgagaaagactgaataatatgatgagcatgtattttctgttgctttttctcttgtctatcaaaccgtgagtcgtagagttggtcatttgaaagaaaattattttgatacatcttcaccagttccacatagtcaggaaaatcaagataattactcatcccaaaatctgaaatcaatgataaattcctggttttcttaggatcaagaatatacttaatcaattgacggcggtattttttcccatgaacagcataatgcttagtgatgaccataaaattctctcaatcgctgacactttatgtcaaaatcttgttgtaactgtgtttctaactctgctataccgagctgcaattctttgacttgttgaagactaagtaggtggctttgatttaccgaacgtgcaatctggtttatattatttccaatcctacgaatttcaaaaatcaggtcttgaaaacctcttgtatcgattgtgataaaattcatacgaggattgagtaaggtttttctggcataatgcgaaaagtttggacactgactctgagcaagatttttattgaggataattaattcttgatcactcaaatacacctttttcaaattggttcgataacgattttccataataacttaccccatgtacttgtctttgaatgaatagcttaatggaatagttacctcaatttccttcatcaagtctttgatacaagtcaggatgatttcaagatgttccatagtaactgattgagacaactttgccagaacaagtatttcatgtacatcccggtaaatctgttctactttttggtgctgtaaatattttatccattcttcaagctgctgagatggttggtggtctattttcaataatttacctctagcaaaaggggaaaattgttcatatccctcctgttccataaaattttgtatctgttgatactcttctattgagaaattgacttccttacgtatctctctaactagatttcccatcctgtatcctcctcattctttaatatcggtatatccccgccctcgtattagacacggcactgcataatatcttcctttcaggtctttgcgagctcagatattgtgtccacaatatcccaaaaatcatatcgccagctgaccaaaaccttccagttttgacagccaacgataagataacttgatggctccgcccccaaacccccagtgaaaaatcaaggattgattttcttaggaatggtattaggataacagggatgatttggaaaaggtatcacaaaattgatataatacttttataggaatattttcaaagaggtgcattatgtccaaatcatctaaacaaattgaagaagatgctgtcgattatttaaaaatggcgttaaaaaaatcgggtattcggattttatggtggaaaagggcttataaatcacccttctccaaattcttaataagtgtggaaaaatcgacacctaagttgtctgtaatgtcgtgatcattcacttcataccaattgaaagtatcgtataacatagctttattgaaagcacttgaattaaatcgtggcttacgctttttatggagcttctcattgaaaaggattttggctcgtaaggcatcaaacgagtaacctctacccattcgctctacctgcctaataatgctgttaattgactccgtataagcattagtgagccttttatcaaagtagttgaatatttcaacatgccagttgtctacggctctcacgaggtctttatatgcgtctttagagttgctggacatacaacggtgtctccattgactataacgaagatgaccttcatctggatcaggagtatcccatatccagtaaaactcttctttgagttcataggcttcttttaaagcaggaagattacctaaccaagtatctaagaggaatgattcacgttcatttagatcgtgtttacgctttagaaggataaacctttcacgcataagggtacgtctttctttttggctcatatgggctttcaaagactttctgacgttatctaaggcttgattagccattctaactacatgaaacttatctacgacaactttagcttgtggaaggatagtgttcactgcgtctttgtagggcttccacatatccattgtgacgtactcaatgtaagtcctgtcactgatttctgaaagacgttggatgactgtttccttgttacggttaggcttgatgtcataaatagtcctgcgttcaatattagtcaatacaagccgaggtctacggataatatgtatctcgtctatcccaagccacttaggagtttcaaactggtattcacgttctttgagtgccacatagtccttaaaaacgttcctaatggttttctcgtcaacaccaacgctttctgcgacttctacaaaggtcttagacatggattgctcttgaatggactttaaaagccttttggtcatactacgcttttcatctacagatatggtagatccgcattcacgacacttgtatcgtctacggttcaaatgtaagcccactcgctttaaacgaatgggcaaatccataattagttgatttcttgaactgtgtttgtacaacttgtcaaaaccacattcaggacaacgttcaggtggtccgactgcttcaactttaaacatcatatcggtttcattttcttgtggcggttctattgttttaatgtctggtagggataataagtctgacatattattcatcctttattactctgcggtgttaaggtatcaattatagatttgatgtcgaaatcatcagtgttaaattatttttgtgaccacaaatgcacttagaaaatcccttaaagcattagctggttcacttgaatagggagttgtaaaaaagttcccttagcctgcacaacaagataatttcgaaatatctttatcgaacgtaagtgcaactaattttagcccttcagccattgttaaatatggtgctagggtttctgttaaatcttctatcgttaagccaaatttaacagctaatgatgctgcatagatgacatctcctgcattttcagatacaatatgaacccctaatacttttagtgtttctgcatctgctactagtttaaatacaccggttgtttcacggtttacaattgctcttggaacagcatctaaaggtaatacagatgtcttcacatcataccctttctcttttgcttgttcttctgttaaaccaaccgttgcaaccgtcggattcgtaaacgtaacagcaggaactaccgataaatctatttttttgtttaatccaccaatagcattatcagtaataattccaccttcataggctgctacatatacaaattgtggtcctaaagtcacatctcctgctgcataaatcttttcattacttgtttgaccaaaatcattgatcaggatttcattattttttccagtttcaacacctgctgcacttaaatttaaagaatccgtatttggttttcttccagtggcaacaagtaactgatctgattcaatgacttctctactgccatttactgttacgtaaaccctttttatctctccactttgttcaacacgctcaaaagttgcccctttgacaaggtttataccctgttcaattaacgctttttcaactgactctgaaatctcaggatcatactcctttaaaagtcgctcacttctttgcataagcgttatttctgaacctaaatgatgaaatagttgtccaagctccattccaatgtatcctgaaccaattacagttaatcgttttggtattttctttaactcaagaagtgttgtactagttaaatagtccattttttcaagtcctgaaatttggggcaacgaaggcgatgcacctgttgcaattaaaaagcgttttgcagataactttgtcccattgacctcaaccgtactagcatcaacgaattttgcttcacctttaattaaatcaaaattatattcatcaattaaatccatatatttttgattccgaagttcgctcaccaatttatccttttgcgtgattaaactagctaaatccacttctccagcggatgtttgtaaacctataaacggattgtcttttgataaatgattgatttcccctgccctaagaagagtttttgacggaacacagccaatattcacacaggttcccccaaccgttccacgctcaatcattccaacttttgcaccgtattctatagctttaattgccgaagaaaaggcagcagcaccagaaccaataataagaaggtcataattgtcttcattaattaacgccacgttttctagtgatgatacttcttcaatttctccggcttggtaatttgcttcatcaatcgcctttattgcactttcaacctcaatatcatcgggcagttcaaatactgcttcaccacgacgataactagactcaatatttttagcacctatcttttcaagtgctgattctacgtgtttttcacaacccgtacaagtcattcctgaaatgtttaccttaaatttattcataaaaaagctcctttcgttaattaatctctcatgttaatgtttctattattggacacgaatgtaatttcttttcatctggacatcgttgttttaagtcgtctaacatagtttcaattcgttttaaatcctctatttgtttttgcacttccttttgttttttagaaacaaattcgaacatatcttgacaacgaacttcatctttatctacaacaccaagtaatttataaatctcgcttaaagagaaaccaaattcctgtattcgtttaataaacccaacacgcttaacgtcatcatatgaatatatccgataaccagcttccgttcggtgaggttcttgtaataaattttttcgctcgtaatatctgatcgtttctttattaactccacatttatctgcaaactcactaatgcgataaatcatcttatttcaccccctgaatattataaaccatgtaccatagtacacggtcaagtaaattggactattttatttttttcccaaagtatcactcgtatgtgattgatacttttatataatactattgattatcctaacatcccaccagaaaatccgatttaaacaccagttgtttttaaactattaagaaagtaattccactatatattccgaagacccaaaaaatcaaaacatattaacagagaaatttctgagggagataaataaccaatctgggatggtcacatatacttttacaaaaatatagaaagacgaaatattgattttttggagcgaattcctgttcagtttaaaggttgtgatgattattataacgaaaatgttggataccctctaagcaggattaatttggagcattatctaactgaaggtggtgtgctctactttgtagtgtactcgaaagacgttagtcctactgtcacttatgcttcactaacaccaaaagtcattaagaacgtattgccagctagtgacaagaaaaaaagaattaagaaaaaagaagatatctttctcctgttctggatggctataatagcgaaattattgattttaccttatcccgctctccaaacctcatacaagtcaagaccatgcttgagaaggtcttccctgaggaaacttacccaaataccattctccatagtgaccaaggttggcaataccaacatgaagtctatcaccgctttcttgcaagtaaaggcatacatccttccatgtctcgcaaagggaccagcacggataatggtatgatggaatccttctttggtgtcttgaagaaagagatgttttatggctttgagaagactttcaagtctctggatcaactggagcaagctatcaccgagtatattttttactacaacaataaatgcattaaagaaaaactaaaaggacttagtcctgttcagtatagaattaaatcctttcaataatattttttgtctaactttttggggtcagtacaatgactcataaatatttttttgcaagttcaaatactccatgagattaataactttattattttagccaactttactaatcgtataaacattctccaaatttctcaacatcaattgagaaatttggctttttccgttgctcagttaaagcgtcctttagttgtatatttcctgttaatatcccttttgaagcataacattgttttcaatgatcgcatccgattgttgacacccattttagaacctattctttgattttcaataagcgtaaactgtttaatgttacaagtaaagttgctcccatatcagcaaatatcgctatccaaagtgttaaccaaccgggcatgaccaaaagtaatgccactaatttaatcgccaaagagaaggtaatgttttgcttgatgattgctaaagccttacggcttaattttattgtatatggcaatttactcaaatcatcagacattaaggcgatgtcagccgtttctaaagctgtatcagttccagcaccacccattgctacaccaacggtagatgccgcaagggctggagcatcattcacgccatctccgaccatccccacactttgatgtttttctcgaagttctttaataaaattaagcttatcttctggaagtaagtcagctttaatatccgaaacaccaacttgttttccgatggctgttgccgttctttggttatcgcctgttagcatcactgtttcgattcccatattgttcaacttgccgataacttctttagacgattccctcatttcatcggctacggcaataaacgaaagaatttctttttctgttcctaacaccatcaccgttttaccttgagtttgcatatcggcaattttttcttttttatcgcttgaaatgcttccgtgtaattcctcaaaaagattttgacttcccacataatacatttcattatttattttggctttaacgcctttacctgtaatggattgaaaatcctctactgttacttcattgaattttaatccattttcttctgcttttcgcataatcgctgaagcaagagggtgctgcgatcctttttcaatggctgatgttatggttattaattcattttcatttctaccatatgtcacaatgtctgttacagctggaatccctttggttaatgttcctgttttatcaaatgctatcgcttttaagtgtcctgctgcttctaaatggataccacctttaattaatacaccatttttcgctgcatttcctattgctgtaaccacagcaactggagttgagactactaaggcacaaggacaaccaaccactaatacagctaatccttgataaatccattggctccagtctccgccaaataatggtggaactactgcaattaaaagagctagtatgacaatagctggtgtatagtattttgcaaatttatcgacaaacgcttgagagggggcccgttctgcttgggcttcttctaccaagtgaatgatttttgaaagagtagtatcttcaactcgttttgttactttaacctcaagtaacccttcttcattcaaggttcctgcaaatacttcatcatttgtgattttcgttactggaacactttcacctgtaatcgcagcctgatttaatgtcgatgtacctttaaccactattccatccattgctaacttttgaccgggcttaactatcatgatgtctccaacttgaatctcatcaacatgaatcatcatttcttcattgcctcgtcgaattaacgcttcttttggggcaatatccattaaagattcaatagattgacgtgctttatccattgaataacgctctaatgcttcactaatcgcaaataggataacaacggttgccccttcaccccattcaccaataattgcagctcctataatggcaatagtcataagcgtattcatatcgaaatttaatcttcttaaatttttgagacctttaataaataacgaatatccaccgattaaaatggacgctgcataaccaattgtcggtagaacatgctcttcaccatactgctctcctaagaaccagctaactacaagtaaaagagctgatatatataccttaatgttttctttctgcttccaaaaaggttctcctcctaccctttgttctttttcatctcgaatttttaaattttcaaatgctcctgctttttctaattcttcaatggttgtcgtccctttaacataaactttagatgctccgaaatttactttcgcatcctgaacaccgggaagttctttaacattattttcaaaaatggctgcacagttagtacaagtaaatccttgaacacgataggctttcatttctttttcagactgttttgctttccctctagacattgatcttcacctctttcttatgtgccaatgcaatcatcataatttgtctgatatgctcatcatctaaggaataaaatgcaagttttccctcttttcgaaacttaacaatcccttgcttatggagcgttcgcaggtgatgagaggtatttgcaaccgtaacacctataatatttgcaatatcacacacacacagttcgtcatcttgacacaatgcataggtaatttttgctctatttttatctgcaatagcttttaacatttgggcaacactagaaatatctactgtctgtaaattaccttgtattcgattgaccttttcttcgtcataacaataaatttcacaagtattttttttaatcatattctcacctcaatatcattcaagtatttgtttgaatatagtataacccttttcattaattaattcaagtgtttttttgaatgaataaaaaaattcataaaaaaagacttggagtacccaattctaataacaaaataaccaaactgcataagactttaagtacataacattattagtattgaacttgttgaggaggtgctttatgaatcagcttgagtttcagcgtaatcacctgcaaatggactattacagcgagagctaccaagattttgaacgtgacttctaccgctactccaacatgaatattccattgatcttcctgaccgatgatatcctcaaaacaatggcgacttcacgtaagaattactttgtcctgaataaggaaaagtccaaagataaccgcgatcacttcttcatatttgaagtaagaaccttagaagagaatccactaatctatcattatacatataagaaaacaactacatacttaacacaaaaataggaactgttcaattgactgttcctatttttaatcttcataaaatctaagctattctattttgaaaaatttaccatcttcgaatatttttccaaaggaccagatggtttaaaactaggtccctgccgaccaattattaattttccttcccagatttcctcagggatattactatctgttagcttaaacaaactttttgagtttccaagtcgtttaaaatatgctccagaataaattggctcctgattactgtcatttgtgataaaagggtctttattcgaaatgtaaaaatcaaactcgttacgatctctcccaaaataaaagattggtatctcaagcatattatcaatttttctattatgaatatactcacatagatttaagtagccactttctacagttttaatcaaaccgagatctagtttatcttgctccgatattctataccctcctagtactagataaaaaattaacaatgcatggtttctagtttcttcaattgttgtccaatcatttaaattatgcttatgaaaatagccatttcttaatcctacaaaagttgacaatgactcaacaatataataatacgtttcgtcatcaataccatcagcaagtaaatccatattacgtggatagaatttctgactgttaaaatctccaaaaaaacttgtaatagatttaagatttatatttttaacttttgaactatcattaaggagtttgtcagagagtgtatctaacggtttagctcctgcaaatattttacggtttacagaatccttttctatggtatgtaaagagatataggaaaatagaaattgttcaatagatttaaaataccccatggctattgatgttaaatcaatattttctgcattttgaagagagtaaaatagttactcccttatatgctttcgacattgattatctgaatattcctaaatatgtcggtctatcaaaggagcagattctggaaaactaccgcatcctcctgacctatttgaatatcccatggtttctcgcattggatatgccggatttccctagttcggctagtgggcttttccactttttcgaggtcaagaagctttttatgctggactacctgatcttgatcttttctggaatgggcacgctatggtttgtacgacatctaaataggagacgagaatcttggcggctcctaccctacttccgccagggaacccttattccccttgctatccttttggctctcctggttagcttcgacacgctgtttgtgcttttccataaagttttctttaacaatgacgcctggctcttcaatgccactactgatcctattatcttagctttacctgccgagttctttatgcacagtttcctcttggcctttggattaatcgaagtcttcctaatcctggggtacttcactactaaatatcgaatctctgccccaagccgttgattaaaaaggttatggttcataagaaaaacagggctctccatcgaaagcatgggagccctgtttttatcgaaaatttatcgatctatgattttccttatacagcatactagctggtctgacccgattctggaagggggtcaaaccagccagtgttttttcgttcctgcttcgttttatttcggctctaatttcaatgtcatagcattgatggcaacaataacggtcgataaggacatgaggacggcgccgaaggccggacccaaggtaatgccgataggagcaaggaggccagcagcaattggaatcgcgataaaattgtagcctgctccccataccaagttttgtttcattttacgtgtcgtcttgtttgctaactcgataaaggattcaatatcccctggatcagactgagtaaggataatatccgcagaatccaaagctacttgcgttccagctccgattgcaatacctacgtctgccaaggcaagggaaggtgcgtcattgaccccgtctcctaccatgataaccgtcttgttttggtttttcatggactcgaccagcttgtacttatcttccggagattgattggcttggtattgaatacctagaacttctgcaactccttgtgcagcttcctcgttatcaccagtagccatgagtggttcaattccgtattttttcagcacctcgatcaagtttctgctggtttctttcagttcatctcccaatgcgacagcgccgattgcttcattattttctacaaggatacttaaagtagcgcctttcggaatatccatacgcaatgcttttccgtatgccttttggctgattaattgatagtggtggccgttcgcctccccttctattcctgctcccgaaacgatttcaatggagtcaaaggaaactgacttaatgcctttcgcttcagcgtggttcacaatcgattgggcaatcgggtgactggagcccgcctctatacccgccaacaagcctgtaatttcttcttcagaatatttatcactcaaaacagtgacgtccaacactttaaattcaccagttgttaaagtacctgttttatccaataccataacatccgctttagtagttaattccaaagcttctctatttttaaccagtaatcctcggcttgcacccaaactagtactacgtgatactaccaagggaatagcaagacccaaagcatgtgggcaggcaataactaacgcagtcacagtaaagataacggctgtaggcagatccgcaatgatcgtccagattagtagggcgattaaagctactacaaccgcaatgtagaacaaccagctagctactttttgagccacattctctgctcgagaaggttggctttgcgcttggctgattaatgtctgaacctgagaaatgaaggactgatcgcccgtctgctttatttccacatagaggactccgccaccattggttgatccaccgatgacctcatctccggtttttttttcaattggtttcgattccccagtcacaagcgcttcgtttacacgagattctccgcggataatgataccatcagctggaacattttctcctgcttgaacacggataacatctccaatctgaagttcagacacagggcgagtctcaatcgaatcgtcttctaaaacaacatgagcatctttcggcaccaactcagccaatgctttttgcgcgtcccctgcttcacccaatgccttcatttcaatccagtgtcctaataacatgattaaaattaaggttgtaaactcaaagaagaagtccatgacatgctctccggtcacataacgagcggccactgcgtaaacactataggcataagaaaccgttattcccaaagtaatcaaggacatcatgcctggagcttttgaattaaactcatctttcgcacccatgtagaatggttttccgccaaaaatgtatagaattgttgccaatacagctgctacaacgtctgcataaggaaagataatttggaaaggcaactgaatatccatcataggcgtaatgagtaagattgcaattcctaatgggagtgacttcaagaaaatctccttaaagctaccgtgatggtggtgggcatgccctcccattgcgccatgatccatttcactgtgatccatattgctgtgatccatctgactatgttccatttcattatggtcgtgttttgagtgatcaatgtcgccgtgattatgatgactatgtgacgaatgttttttgttatttctcatttttaattcctccttattatattagagactgattttaaagttttagaactttctcatctaacactacatataattctcacgaaaagggttctatactttatctctagctactatctatgaataaatgttattcgtactttatgcacttaatactgaatagttagtttctgctaaagcagcattgagcgtttcggtatcaatctctgtttgactttcaagtactgcttttttagtcgctaaatcaacctctacagattcaaccccttcaatagctgaaaatctttcttgtaccgtgttcgcacaacctgcacattttacgccatctaataagatttcttgtttcattattttattcccctttttttatcttctcctattatatagaataggtagaagtttaaatcccagataagctacgtgttttctaaaaaactgctggtttgaatcgtcttaaccgtaaagcattgagcaagaccgatacggagctgaaactcacggcgactgccccgccaacattggactcatcaatagtccgccaaaaatatacaaaagacccatcgcaactggaatacctacaaggttgtaagcaaaagcccagaacaagttttgtttaatgtttcgtagcgttgcatgacttaaatcaatcgtagtcaatacagcggttaaatcattacgcataaggacaatatcagccgattcaatcgccacgtctgtacctgatccaactgcaattccgacatttgcttgagctaatgcgggtgcatcgttaatgccgtctccaaccatcgctaccttcttgcctgcctcttgtagttttttgacttcctctgctttatcttcaggtaatacttcacttaatacactgtctatacccacttgcttagcaatcgctttggctgttcgtttgttatctccagtaatcatgattacttcaacaccgcgtcttctaagtgctttaacagccttcatggcaatcgcattgcccttctgtacactgacaatccacttcttctactgcgaaagatttttttatctctaatattttctctagtcgatctatatcatcgaagcttaagacatgatcttcaatgatgcttcctattacatttccgactttctttttgcaaatacggttaaaaatatcttctgcaaaatcccttacggcttctttctctacaatattggcagtgtaaataaactttctaccttcttgctctgtatttagtacgcctttttcaactaatcgacctaagatcgttttgatagtggattctgtccagtccattttttctttcaatacagagatgactgttttactagttactaaatcatttgcccaaactacacgcattacttcccattcagcatctgtgatagaagtattaagttctattgtgctcattttcctttcctcctcgttgtttacagatgtaaacgaatatgttcaagataagtttaccattgtaaacgaaatatgtcaaatcttttttataaatgtaaacttggaatttttttcaaaaaaagttaagttgtattgtatcaatttcagaactcacacttcggttttagtactcattttaatacaaattttctaagcaagaaaaaaagtcactcaataggtgactatagaacgtagacaaactctatttttagaaggtgtaaattaaaattatttaattaccattatttcaactaactcttgaaacgctcattttatcgtgtatcaggagtttttcttctctagaagaacaaaaaagattgaagaaaaattgtcccaaatggactttttcttcaatctgaaagccccatttaaggggcttttttatctataaaataaagttcagaaaagtctcaatcgtgccactttcatacatgatgtatagtccaagtggaatgaatactaacggcacaatgattcgctggtatttttcaattgtctcggatattaacggaatagaagatagcacccaactaagctcgcaaaagataattatgccgattgcaaacacaagcaacaccacgagggtctgtgaccaatctaacgaagcaaaataaggtatatagatacctaaattatctccgccagatgcaattgtcagcaatgttactgtccaaaacagttgatttgccttgctttgttctaatctttcaataatttcttcctcttcttcttcctcaccttctccaacaattgcaaagcgaatccctaaatagatagggattaaaccaagcaatccaaccatccatgcttcaggcacgaaattgacgacataagcagcaactaaactcgcccctacaagtaagccagtgcctagatactgccccgcataaatatgccatttctgtttattctgtgatagctgtgcaaataaaataattaaaacaattaaataatcgatactggtggaaatataaacaccaatagcagatatgattgtctgtcccataaaaaaaactcctgtattagtcagtaataaatcagcaaattttaagagaacacagacacattaatttagctatccctaatgggtaatgtcgaacgtaggaaagcattttactcctcctcaaaacatagttacaaagtaatttctaactggaattcggtgaccacttccatgtaaagtataacccattatactttacttcgtaaatgtgggctcgctgaggggtcttgcagacagctatttcggctcttttgagccgagtatcagcgcacccttacctcattcaaatatatttttgaatgtattctaacattaaactttgtagatgtcaacttcagctccgccaaaatatagataagaagttagtgtaccaaatataaaaaagccctgccatccaaatgataacagggcttaacttcaatatccaaaggacatattcatctaaaaaaggtagatttcttattgatttatattgcaatgtaatgaacttcaaaaattcaaaaatcgcttaaaatcaatgttttgacgtctaatgacgcgtagtgaaccacttacttaacctcagtaaagaaaatatagctaaaatagattttgactttcttaatgaggcacttaatgcaaatattcgtttgaaagaattagtagatgaactaaaaatttcaaaagaactggacagtaaaggttggtccaaaaaagactctcgaacgataaaaatcttgtacgatggccttatcaataaacatatagtttccctagatcgtgcagattataacattatccaagtcattccatttgctaatgtacatgtactactgtttttaataccagaaagggagaattctaaaaattatagaatatacaactacagtgattatgaaatggagttaatcaatgaggataggcaacaattttcaaaatatgaaacagttgatttagaccaattgatacttgttgatatttttaatattgatgactacatttcatcatatttaacaatataggatatagagaatctggatcttggtcttttaaagttgataaactatgctgataataaaagcgatagacatattttacaaacctgtttagaatttgctcaaaaaattgtagaatcagataaatctgaatatagtattctcattttactacaaataaaaaaacgattaaacatattaacacaaatggatagcaactatcttcattctctaatgaatcaaagttcggtagaaattaggtttgctgcagcctgtattctaggtaacaaagaacaagccagatattttttcgataaagaattcgctgatgaacaaaaagaacgatttctggaatatccgatttattacctccttagcctagactaataagttttaactataatgttaagttagagaaaacattttacaattgttttctctaatttttcttttttagtttaagattaataaataatatttttagcacaaaatttttactacttgcatcttaaatcttttatgatataattttgttagtttataaaacaacaatagttttcaggaggtaatatgttttctggtaaacgattaaagaaaagacgaataacacttggctattctcaatctgaactagcagataaacttcatataaaccgctcttcttatttcaattgggaaaatgaaaagactaaaccaaaccaaagcaatctcaaacaactagctatcctattagatgttcctgaaacatatttcgagtcagaatataaaatagtcaatacttatcttcagctttctttacagaatcaggaaaaggtagagaaatatgctgaggaattacttcaaactcaaaaggttcatgaaaagattgttccactgtttgctgtggaagttctatcagaaattcaactatctgctggtccaggtgaaggtctgtacgatgaatttgaaactgagactgtctattcagaagatgaatacacaggattcgatatagcaacatggatttctggtaattctatggaacctgtttataaagacggtgaagtcgctttaattagatcgactggttttgatcacgatggagctgtctatgccttgaattggaatggatcgctctatatcaagaaactctatcgtgaagaagatggattccgaatggtgtcaattaacccagatgttgctgaaaggtttatcccatttgaagatgaaatcagaattgttggtaaaattgtaggccacttcatgcctgtgattggaggttagtaatgtcaagacagtttgacgacattatatttattaaagcaaatagaattattttattactcgaccaaaaagaatatgatgtaactaaccatttaactgaattggttgatgaattagcaaaattgaaatctaggtgaatactatgggctatgtcgactactcaaaagaacctcgtagcgatattgcttttgtcgatatgaaatccttctatgcatctatcgaatgtgtagagagaggacttcacccgcttcatacttcactttgtgtgatgagtagggcagataattcagctggtctaattctagcttcttctccaatgttcaaaaaagtctttggtaaaggaaatgttggcagagcctacgacctcccctttgatgttcataccagaaaatttaactactaccgtgctaaaatttcaggattgccaacggatgcaaaatttgtttccttcatagaaaattgggccaagcgtacatttattgtgccaccgagaatggacttgtacattcaaaaaaatcttgaaatacaaaaagtatttcaaaattatgcagatccgacagatattctgccctattctattgatgaaggatttattgacttaacttcatcgctaaattattttgttgaagacaaatctctgagtcgcaaagataagttagatgtggtttcagcaaaaattcaacacgatatttgggaaaaaacgggtgtctattcaactgttggaatgagtaatgccaatccacttctagctaagttagcacttgataacgaagctaaaaccactgctaccatgcgtgccaattggtcttatgaagatgttgaaacgaaggtctggaatattcccaaaatgactgacttttggggaataggttcacgaacagaaaaacgactaaacaaattgggaatctacagcattaaagaattggccaactgtgaccctactatcttgaaaaaagaatttggtgttattggagtacaacattggtttcatgctaatggcatcgatgaaagtaatgtccatgaaccttatcgccctaaagcagtcgggattgggaattcgcaagtgctccataaagattacactcgtcaaagtgatatagagcttgtcctgcgtgagatggcagagcaagttgcgattcggctacgcagaagacataaaaaagcaactgtagtcgccataaatgtaggctattcaaatttcgaaaacaagaaatcaatcaatgttcagagaaaaattaacccaaataatcgtacgcttgtttttcaagatgaagttgtttctctctttcgttctaaatacgatggaggggcagttagaagcattgctgtaaggtacgatggattggtggatgaaaactttgctgtgatttctctttttgatgactttgaagaaagcgaaaaagaggaaaaattggagacaaccattgattccattcgtgatcgttttggatttcttgctgtacagaaagctagttctttattagaaaattcaagggcaatttctcgcagtagattagtcggcggacattccgctggaggattggagggtttaaaatgattgatagaagttatctcccatttaaggttgctagagaataccaagaccgaaagatggccaaatggatgggcttcttcttatcagaacatacggcaggacttgatagtgagcttaataaagttgactatacttctgagttatcaatttcagataaactactgctgctcaatcaattatacagtaatcagttgaatggtatcattgcagttcctggacaatattacagtggaaaagttgacaatctgacttttaaccatgtttcattgaagacaaaaacgggctttgtcagcattccaatcaaggatattctttcaattgatttggaggtggaatatgaatcagcttgagtttaataaaaatctattacaaatggattattttagtgatagctaccgaaaatttgaagaggatttctatcgctactcagccctagatactccacttacttttttaacagatgatattatgcttgccatggcaaaatctcaaaagccttattttaagctaaataaggaaaattcgaaagaccatcgtgaccattattttatgttcaatgtggaaccttcacgagataataatctagttaggctatattgttacgattcaacgaagacacatatttcaaaaaacaggccaaaataattggtctgttatttgttattattgctctctcgcctaccttgtctaaacctctcaatgtttttttccaattgttccgtgtgaagtttatttttcgcttcctggattgacctatcaagactttgatcctcgtcagttatatcgctttgagataattcaacgctcgtatcaggcttaaaatttgtatcaaaaaccacatctaggagttgttctactttggttagttcactatctgacatctctgatagtcgatgaatcagtcgtttgaattgatcctggttttgttttttcttttgaaaaaatttcattatattctccttcaattgtaaaaaggtagcccgcataggactacctgacttataaatcatcaatggctactgaaatagcctgcaactttttattttggattttcttttcatcaatcaattgatgaagttcttcaatttgcttctgacaggcggaaatatccttgttgttttgtgcaatggtatcagccaagtgttgtttatagtcacttgtgatatttaccttcttcggctgattttgtttaacggttgatgcgagcgtttgtacatcttttgattctgactccttttgttgctgttcaaaagcagccacataatctacttcttcaattggtttttcatcctgtttatgaaaaagtgctgcgattttagctcgttcttcatgggacgatgttggtttcacatcgtctagtggctgatcaaaattccatgttttactcattctgtatcctcatttctgtaatttgggtgtagtgtggtttctttaccaaaggcttgctctagtgcttcatgaaatgacaactgacttgattgttgtcgtttgataaaggtgctatacattgcagtttgtagttggtctcgatagtgttccaatttctcagtctcacgtgagaccttttcttcttgcctagctactttttcagccagacgttcaatcacactcatagggtgtcctccttgtcactttctagattatgatagcggacttgattttgttatcacaattccaaagcgtgctctcgtttaggtggaggatgattcttattgacttgtgcttgggctgactggataagatctcttaaagataattccttttgtcgtttcacaatatcattccaatctgactttgtttcaagtctttgcaatggtggtaaatcttgaaaaatcggaaatcctttatctgacagtttctgataaaattctcttcctgcttcatcgttatcaacagccatagttatgacgtttgaatgagtttgaaaaaaggttgtcgtctcttgtattgcctgaagataatggctaagtctaattggttttactgtatctagaaatgccaatttcccctgttcctctgctgctagacgcaaagtctgataagcaatcactgaaagttttaggccttccattgaaatcaggcgaacatctgatagctgcttttggtgaagttgataataactcatcatatcgataactgattcacaaaaaatgagtcgcttaggattcccaatatcgaaactaataccgacatggccatgagatcctttcatgatttttttgagataacctcgatcgtatttttcttcatttttgacgagaccttgaaggcttgcggcctgtaaggtcccattatggtcaaagcttttaaacactaaaactgactccgcttgataagtagcttgagcaagcaatccttgtctgccaaaggaattaatagtctgattacttagtccacggatgtctttcaagtaagtacgtgcttgctgaaagggttcttcacgcaaataatattggaagggttgataagtttcttcaatcaccttagcttcttcaaagcctccagtttcaaggtaagacaaggcttttttgaaagacactcctgccactaactgtacaaagtctatcacatccccttgtatatctcttgaaaaccatttgaaagtattggtatccgcaaaaatccgaaaggaatcatggtctgggtgttcataaatttgtcctgataaacgtctgaaggaataacccaaactttcagccacatctaaaatggccttttgttttactattttaattcgtgtcatcttgtctccctatcaaaaaagcagaagactgtctcctgctagttgttctcgcttgttgtagttccttggatcgttggtatgctggaattggctccatctgttgcttctttcatgtcctccagtttcccattccaaatggtcaactgattaactagaagcttgtcggaaactttggagtaggataacataactgtcttggtttctgtctgagttgttcgctgttgttgctcactcaaatcagaaacataagttacttgataggaaacttccgcaagtgcaacatggctttctgtattgacatagatactggctgattcaaatcggtagtcaagcatatagtctttataaacttgattgatcgctttattctgatttgcttcctcttctgaaaatgccgagtccgtcatgtagggtttgatacgagcgttattttcacccagctggaccttggtgaaatattgagtgagaaattcattgacaagctcatctgataggactgtcgctctttcctcctgctttttctttgacacaagtttattggcttctgctcgtatttggttctctgtttgctttgaaatggtttgtgagccaatcgtctagccaatcatgaccataaaactgactgcgattaaacctcctactccaatcagaaatcgagctttcactttatttaacatggcttactcctctattagtgatagcttcatcatatcaagattagcttggagattttatcacaagaaaaaggactacccattggtaatcctccgtgttaaactattctatttctccaccacttcataataatgctaaaaacaagaaatagattcaaagcaataaaaaatcctgtaaaactccaaactccattagttgctaaatcttctgaatagaggtatctctcagtaaagaagaggtaaattccatagatttcaataaagactaatccactgatgagtccgataagaaacaaagcacctgaaactttcacaatccgataaaggacaaacaacatcagtcctattgctgcgaaaatcaaaagactttgtagaatttgctccaacatcttacacctctttctaggctaattgcttacgataatagttggcttgttcctggtcaagttcatcaagttgggtaaccaagtcaaggtattccgtcttcgtcacctcatctaagtttgaaaaatcattctcacgacttttgatgatgagttccagctgtccagtaatttcacgctttgaaaaactgtaatcaaaggtctcatcttcatactgttcctttaaagtttggtagtttgccctatcttctggacttgtatagccttgtgccaaccattcttcaagtttataacgcatttcttctagtgtttgggtcatgatctattctccttttgtgatttcttgacttcattttaccgcgttcaaaattatttgtcagccttttttcttatatctcgagtgctatttgttgcttcttttggggtgttgtatcttcactaaacttggccaaagctgcatctatctcttcaatctctgcttctttttcaaccaagggagctaaaacatcatacttagcctttacaagctgatagtcctcttcctttggaaagactttatcaacttctactttggctactcgtagcttatcttttaaatcctttaccagctcttgcgtcttttcttggtcatctataatatggtcaatggcattactaatccgttgaatggttcccacgtctgatttcaaatcaagggcgacagtatactggttatcacctacaatcattaaagaaatggtttctggtaagggctcactagcacctcgtgtagtcatttttaaatcaaatcctctaaagctggcaagtgtcctgacttccttggtctctgagcggttataggtaatgagttttcgcagatagtccccagcttcagcacgattatccattgcttgattgtcaaatcgcatgacaaaatcttgcgacttggttgccaaagattgggcaatatctttatcatattgactcaaccgtttttccataatagggaggtgcttctcgctataggaaatggtatggcgatactcgtctttggagcgattaaaggctcgtttttgattctctaaaactgtcagttcattttccaactccattttgagtttgagataagggttcccagttgccaatgccttaaagtctgaggcggtcatggtttgttcatcaatgtcttcagctgatctcacaggatcttttgaggtcattatctgggtgatatactttagcttattctcctgcgtctgccagaggtaattgtcaaagctccctttagtaatatagtgataaatatctacctcctggtgcatgtttccttgtcgaattagtcgtccatttcgctggacaatgtctgagggcctccagggaacgtctaaatagtggacagctttcatgcgagattggacgtttaatcctgttccccctttttccgtagaagccatgagaatccgtacttctccactattgaccttgcgtgacagagagtttttcttctcatcagtattggcatcatggacaaaggcaatttcttcttttggtatccctcgatcgacaaacaagtccttaagttcattgtagacatcaaacccttcttccttacttttaggggttccaatatctgagaaaatcatctgagtggctttgtctccagctccatcacggtaaatccgctcgacattatcgactacttgaaggattttctgattatccgataaggagtaagtagggtcaatcaaccgcatatcaatagctagttttctggcttctcctgtgattttaagcatgttatctctacttggatcaacactacctgacttgatagcgtctgaacgctttaccagctcttccaaatagtatttctgagcttgcgttaactcgctttccaccgcaataatcttagcttccggtactggtaaatcaagcatgtctgaggtctgaatatcggcagtttccttgtagattcgcatgagttcaggaaggttgacaaatttcttgaaccgtttcttgggttggtacttatctcctgtcggggctagttccatggagttttcgatattcccaaaagccccaacccaggagtcaaaatttgataccaggtatcgttccaagacatcaggttgaatgtaatccatcatggtgaaaagttcactaatagagttagaaactggtgttcctgtcgcaaaaacgacatttctatctccatgctctgcctgtacttgtctcaccttcatctccatatccacgttctttttagaagttgtgttggtgattccagctacattcccaagtccagtgattggacggatattcttgaagtgatgagcctcatccacaaaaagaaaatcaattccaaggttttcaaactcaataaaggtatctcgctctagtttttggagttcttccaactggtgttctaatcccttaatcgaacgttccgcttctttcaccgtgtaatcactgtcacttcctagcttgatttctcggagttgctcaagtttgtcattgatataggtgacctgtttttcacgactcatcggtatcttctcaaattgtgaatccccaatgacaatggcatcatagtcccctgtaataatacgggacacaaactgcttgcgtttggctttggcaaagtctttcttagtagtcacatagactttcttggtagggaaaaatttcatgatttcttgaccaaactgagcagtcagactagacggcaccacataaagtggtttatgtaccattccgagttctttcagtttgaatcctgccccaagcatggtaagtgttttacctgaaccaacttcatgagctagtagagcacgtttttcctcgacaattcgttgaatggcattcttttggtgaggacgtaaggagatattctgagcaagtccatcaatggttaaatgactaccatcataggactttgataccgtacgattgtagagcctattataggtgtcttcaatcatttgttggacttctggatactttgctacaaaaccttgaaagagttcttgtaggtgtgtttccttggcacgcaggaccgttgttttctctacatccgtcacattctttttcttatccccttcgacaacttgttttgtgatggttggttgattggaattcaggagattttcaaagatttttcgaccactatcatagcgtgaagcagggacacctaaactcctatccgttgcgttggaataggtgtaggcaaacttagattggtaagtgataaccccgtcaatgggactgacttctaggactgtcgctacttcttggtctgacagttcataggctttccccataaaggtttcttgggcaaattttccataaacagccagaggaatccagcgtgaaccgattcgataatcaatgtctgccaaagtaatacgggctggtttgatagcttctagaagtcccgcataatgtgaccagttaaagtcctgattgtcttgtttgacgaatagatctaccacttctaacttagtgacgacatcccctgaaagaaagtcttggcgagaaacataggtcaattctccattcaaatacttctcaggatcaggcataatgaggtcgcctaactcctcaatcaaggtcatctgcgattcaacctgatagatagacatcatataagcgaaatcaacacctcgtccgtcagccaagctcgaatttaaggcatcaagggcagtatgcacctttttaacctctttttcaggacgcactagagccttctcaaaggcaagggatttagtatagataacagactttccacttggatccagactttcatcttccaaactagcaagaagcgaatacttatcatcactatcaaaaagattgcggttcacagcactattcaaatacccatagtgtttgacaaagctatcataggtacgattgagtttgcctaacaagtggttaaaggtctccttatcatagtcataatagcgttgaatggcaataacttcttggtaggcattgcgaatatcgaccattcctttgatacgtgccacttctttataagacaatggagcttcatagaaaactgtctttttataataccccttaaactgaccacgtttggctgcatcatcggtcacatagacatccagagcagtgttatcagtcacttctaaggcattaaagcgatcaatctgcttttgagaatgtttggtgtcccatgctttgaagttgccctcttcatcgacatagtaactgatttcttccgtcttggttccgactcgaatgcctttgttatctcgatagtaaactgtagacccctgataaccaaaactgtactgacctagattttccctcatttcagctggaatggaggtatcattgacttgtttggtcaacacatctgggttaatgatgacctcatttctatcaatctctcttggggccttaacgtgatttagagctgtttcaacacttgcaatcaagtcatcactagtccccttaacagaaagtgttcctccgttaaaattcctgacctcgtaggttcctagcacctggctattgtattctccatcaaaataaggattgagccaaatgcgactatccttgtcatagcgaatggaacctgaaaaggctaaatcgtctgccacatatcccttgtctaagtgtttctggaagaataacatatccgttgtgacactcgttcctgcaatggccttaaaggcagagtcaggcagtcgaaccccaccaagaaattcagttgtctcacgaatatcttgtaagatgttttctgttcgcttatccatagttcctgtggaagagataatcgctacttgtccaccatcatgaagcaaatcaagtgactttttgacaaagtagtcatgaatcatgtaaggcctatcgtacctattatccgcaattcgtatattggcaaagggcacatttgaaatcaccaaatcaaaactattgtcgttaaaagccaccgtctcaaatcccttaatttcaatatgactattgggatgaaggtgtttggcaatagctcctgtaatagtatctaactctacgccatacaactcactcttttctcttaagtgttttggcatagccgcaaagaaattccctgttcccatggaaggatctaggattttgccacctgtaaagccatctctttccaacttatcccacatctgacggatcagggatgggtctgtgtaataggctgtcagggaggactgtttcatatccgaatactctttatctgtgactaggctcttcagttcttctcgttccttagaaaattttggattatagtcatcaaaaaattcattggctagtccaccccagcctacatacttggcaaggagttcttgttcacttggtgaagcattgcggtgctctacttctagattttttaccaaacgaatggccacaatgtttgtctcaaccttatctctagcagtcttaggataaaagtccgtcaaatcttctggaaaataaaagtccgttactggaatctctggaattgtttcgacgacttcctcttcaggaatttgattatctgtttcttcaagatcagtatcgttatgaccattttctgaatcatctggttccaatagtccaatactctgaactggctcctcttccagaaatgagaataggtttaattcttggtccgcttcttctaactctgtttgtggttctgcctttggctgatgaagtgcctgactgacttcttcccaggtcctcacataaagaactggattttgttcaatgatatccgaaaagtcattgactaactcaatccgaatcaaaccgttcaatcgagcatcgctgaccgacatgacctcaaagtcctgtcccttataggaaaccaatgaccccagaggataagtgtccaatactctctgaaccagtggattttccgcgaattcttcatcaactacttcttttccctcagctttctctagcttgcttttccaatctctgagagttaaatctggctgattacctttatctttttcaaattgctccgcatcttctctgctgagttcttggtataaaaaggcgtaggcaacttgtcgcagctcttcaatggaaagctggctaccaaagaaaaattcaaccttttcatgacttagtcccatttggagtagttctgtcgcaagggctagttgagttaccgaggctttgggataaccacctagtaaagcaaggtctgcattttttaaacgaaaacgacctgctgcatccaataaaataccgactcggtctgggtcaaactgagataaatcaatccctagctgagtcaatttttcttgattttctatcctaatggcttgtccaattttttctaattccttttcttcgactgtagtcagcgttcgtttcagctcatagggactgccatcagcttcgagataagtaagtaattcctcgccatcaaagactggtgtcatttccatctctgtgtcaaaatcacctcgtctaaaacttgggactttggaacgttcatttcgaatttggtcaaaatatgttagaatctcaaatttacgtcgtaaggataactcttcataagctggcagatgactggtttttcctatttgaacatctagttgagacaaatctacatccaaactagcaataaccagagagccctcttctcgaaaagatattgcttgatgaacacttgttttgtgctcatcaacagtttcttcattttctagaacagtttcatcagctctagtttcaagctcaggctcgtaagttaagagaaactgttcaatatctcgactaatacgatccgctaaattattagccacacgatacacattgaccaaattagctcccctactcttttgtaagagtgaatccggcgatatggtttggtagtgtccattggaatccaataattgaaaacgagtggccagattgaacaaggccacttctatcaccaagtttttttcagacggcgatagtttatctagtttttgaagaccactttggccgaaaacttgtgtataggtcaatagatcatgagcagtatcataaggactagcctggacaaaagctgaaacatctgtctcaaagtgaagtacttgaacagacttatttatttcttgcctattggtcataaactgatgaataagactatcccactcctcatcaaaatgctctgcttggtaatataaaaatgcctcaagcaaggctctatcacgaggaatagtggctctcatcatttgtagtaagacttcttgattcattttccctcccattttaaaagggctgagagtgtttctcagccctttgagttaatctaggaccaaggttcgttggtctctttcttgtggaataccttccattacaattgccacatagtgttgtaagaaatgacttttctggtctagtaaatctttttgcaaggcaaggtgaaccaaatctccaaaataatcctgactggaaatagccaagtcctgttggatcatggcctgtaaggtttcaaggctaagtggtgaataatcgtcactatccaaaacctcatactgttccaaggtttctgagagactatttgaggacattaaatccataataaaattagagccttcacctgttcggtacagcttttccagaatgtcagtcatatctgcctgtacttcatcctgataactatcaactttaactcgtagctcatcacttatcaaggataggtcatcctcatccatataatcttgataaacctgattgaggattgttctattagaaatacttaattccaaagagagaaaagccttgataaactcttggtaatcgaccttctccatttcagacaaagcctctttcatggtgtcaaagttccaagtcattgtacaactccttttgtgggactaatggtgaatgtccagattgtagctcctctaaatcagcttgaccatcaccatctgtgtcaacagactgcggatcggttcccaaagctagttcctgagcatctgtcagaccatcctggtctgaatccttttcataaatagtttttggattcatctacttctcctcctttttcttcagtccataagccgtaccaagtagaataccagctccaatcaagcccaaaagggattcctgttcccctgtatttggcaaaatacttgctggaacaggcggttcaatagtctcaattggtggttgaggtggagtgggttgatttggacttggttcttcaggttgaggtgtatgtgttacaactgtatttgagctaatgacatagccattcactgtatggagataggtattctccacctgaccagccgcaatccgtttcatttgaaggtaaacatctgcctgaaaggctgaatcatcagagacagtctctaagaaggatttatcaaatgaaattgacacgaggccattttctgtatctacctgttgcaaggtgtatttcgtgacttctgtcccctcttttaagacagaaccgtctttgaggatgacatccgtcatcagatagctgcgataaacaccattatactcatcatgcttttcatcatagttatcttcaaaaccatattcaaataaatcagtcgcacgattgcttggaatcatcgctccaaccaagcgatagttaaaggtttgatgcaaggccacttctttcccgtcaaggctggcatctttatgagacaagtcgatcaccacatctttttgtgggtctaattttggaacattattaaccactgtttccgtgacataggccaagccaaaatcaatttgataggctgtattttcatactgaccacctgttttggtcaactcattttttaccgtcatcggaagcgtgacaactaaggtttgaccagtcttcacataggtatcataaaagacttttggatcatcgctactaagaacttgaatggctcctttaggtgtaaactgacgtttagccatggcatcttgaacaactttcggagcttctgacaaactagcgtaggtgctgacagagataccagatacacgattgccatccttatccaaaacttgaatgccatcaggatttagggtaagggcttcttctgggtaatcgtctaccatgtaaaatcccttggcaagaacatcatccgtcacgaccatatccttgtattgactgtaatccaagacaattttgtaataattgaccgtattcggaagaacagtctttccatcaattgaaataccttcttgattggtattagacttatgtggagttactttagggacaaaattggtcaccgtattggtttcataggcttgcccaaagtccacctgataagccacgttttcataagacttccctgaattaagcatggtttccaaaaccgtcattggagtgacaatggtaatattctcccccttggtcacataagattcaaaaaaggcttgtgggtcctcaggcatgaaaacttgaaaagctcctttaggctgaattttttgtttggaaaaggctgcttgtagcgttttaggagcttctaataattgagaataagacttcaccgtgattcctgaaactgttttgccatcagatgtgacaaactgaatagctgcttcatctggcaataaagcttcttctggataatcatccacaaagtaaaaaccttgtgcaatctgagagttgtctgctttaatccctcggtattggtccaagtcccatgaaagagtatagtgattttgagttcccactagcatgggcttcccgttgatatccactttatccttgtttaggttttgtttcttgggttctggtgaaacaagggtgttggtcacttccttggtttcatagccattgccgaaatcaacttgataagccttgtttgtataggtctttgtctgaccatagagactatctttaaccgtcattttggtcaaaagagctaaagaagttcctgtttgaacatactggtcataaaaggcttggttgtcatccggcataaagacttgaaaggcacctgtcggtgtaatcttagcacgagccaatttatcttgaaggtctttaggggcttcatttagggaagcatagtttttaactgtaattcctgataccttctgaccgtcaagggttgtgatagccgtgccattttccaccacatcaagcacttcctctgggtaatcgtccacaaagaagaagcctcgtgcaattgtctctttagcagaacgatctcccttatactggtccaaatcccaagtcaaacgatagtggttggttgtaccaagggctacgaccgtgtcattaatgaggacaccatccgcattttcattgtttttatctggtgtaatgagcgtggttgtctccccatcacctggtgtacgaaccgttacaacatttgaagtgactgtgtaagcattggttgtacccttgttcaaaaggagtttgtaactattggaataggttgccccatcattttgaacagaaccatagagttttggggcggtcaattgataaacctgagttaaatctttatttacctcctgcaacaagttttcctttgcggttaaggtcacaaaattcttagtctcatcaaagctaaggacatagtttccattctctttttgtgttgtttccttatcaaataggtaaccagcaggcaagtagtcctcaaaaatgagactagtcgtttgggcacgattgggcgataaggcatcaactgttaagggataaatcaccgttgaatcttttgcgacagttttctcatgaagattagcttggtcactattgaccacttctttcataatctctgaagttgtcgtcaaacggtacgcatgataatggacagttggtacttgtggtggcgttggaagttcttttggaataggtttgacaggcaaggttaccttggtcaaagttagactaggctgcactacttcatccaaaggctttggtgtgaaagttacaggcttttctggtgtaaatgtttttggtgtatagatatctggtgttaccgtaataggttctggaatgggttcaagttccaccgttacatgaggtttgggactatatggtgttactgtacgtgccactggtagggtatttaaggcgaaccagtatgacaagccaacattctgtggcatatcgccttggccaaaggttactgtgtaggtattacctgatgtaactgttgagacaatagctcctttataagcataacgacttgatgtggtatcccattcctcaggtaaattcaaatcacttgcacggttggaacccaaagaacgtgctagaccttcattagtcacttgaacagttgaaccattaatcggcacaaatttcccagatgaatctttgacatattctaaaccaatgtcattatgattgagggaagagtgtgtgaagactcctggcttttctttggagaaggtaacttgtgaaccgtcttccaagtaatacttggcaactacacgaaactccatcttgtctgttcgccagtcaccgtttccgtcatttcgataggcaataaaaccctcggttggatcatttggcacaaccaatttcacggcattggttccagctggtgatacaaggttggtaatatcgtaagtcacacgactaatctttttaccatcaaatcgtgcatgttgaagattttgatagttaaaactaagagtctcacctgttttgaacatgtcatagacaaagaatcctgttgaatccaatattcttgagtagcctcccagcaaagcatcgccagttgaaatgatctgatcaggatttcgggtaatggccccatgttgtgcttggggttcaccgttgttgagattgagggcttgagcaagggcttcagaaatataaccttcttcaccttttgaaatctcggccaagtcacgttgatagcgttccatttctttggtattataggcatcaatcgcttcattctcttttctggctgcggcttctttttctttattacgttttgtaatagcttcaatctcggctgcacgatctgaaactaattgttgtttctcctgattagcttgatctactgcggcttgacctgcacggttttcagcatcaacagctgcttgaccagcctgattacgcctttcaatggcttcattatctgcctttgcattagcaagtccagcttcattttctttttgaatggcctgatttttcgcaacaatatcatctgcctttgttttctttgttagataatccgctacagcttgttcgttagttgattgaatggtttcaacagccttgccatagtttgtatagtcaaggacagatgtcccatttcctgatgaaactacttgttcttttactgtcacatcagcatctgcataccgagcttttaggtcattgactttagtatcaacccaagcatttgtctctttaccagtttggttggccccctcgtaggcctgtgacagctccttattttcctgttcgatgcgagctttattcgattcgtatgtcgctttatcagctttgtaggttttagtgacttcattaatagtctcaacctgtttttgggtatctgcatctgcttttgaaatttgttggttggtttctaccgcagatcttgtatttcctaaatccattggactatcttcaaccgtagaaacaccttcagcctttgcttcttcaactgcttgtgttaccgtatcatgtggtacggtaacagcaatcgcaccgttagattgtccagttgatgccatactttcagtttgttcagatacagggtttggttgtgcttctggtaaatttgtggctggattctccgttcgttgaatggtggtgtcaactgaagttgtaacttcatcggcatgtgcaaccgttcctccccaagcaacaacagccgtcaccatggttccaagggcaacggaacatagagtgcgatattttttactcttgcgaaagacgtgtttctcgcctttttcctgattgacaagaaagtgatgattacatgttttggtcataaatagtccttcttttcttttttatgtagcaacaaactgtcactctttattagatacgagggcgttagcgagcacgacaaaaataggagttttgacgaagaactttccgttctatgagaaactctctttttttgtacagctcgtagcccaagttcaataccatcataaaaaagaaggcttgattttgttatcacaataaattgagggaaaagaaaatgttgcttttataccacaaatattgtaaaattgtagtgtaaaagcaacaagtggggggccgtatgtcaaaaaaagagattctactcgattttatagaaaagaacaatggcattgtcacaaacaaagattgtaaagcactaggtattccaacaatatatctgacaagactagagaaagaaggcattatcttccgagttgaaaaaggtattttcctaacccaaaacggagactatgatgaatactacttctttcaatatcgttttcctaaggctattttctcttatatttcggcactgtatctacaacagtttacagatgaaattccacaatattttgatgtgacagttcctagaggctaccgctttaatactcctccagctaatctaaacattcactttgtctctaaagaatacagcgagctgggaatgactactgtacctactcctatgggaaacaacgtaagggtatatgattttgaacgtattatttgtgattttgtaatacatcgagaaaagattgattccgaactctttgtcaagacacttcaatcttatgggaactatcctaaaaaaaatctagcaaaactctatgaatatgcgacaaaaatgaatactttagaaaaagttaaacaaactctggaggttctaatatgaacaaagctaaattaacagcactctgtcataaaatatcaaagaatactggtttaacctttaattccgtgatgacctattacttcctagaagtcattttgaaaaaattaagtcaaagttcttattcaaatcactatatcttcaaaggaggattcctactgtcgaatgtcatcggagttgaatctcgtagcactgttgatattgactttttattccatcaaataacactctcagaagaaactgttaaacagcaactcaaggaaattttagcagattccgaagaaggtatatcttttgtgattcaatcaatcacaactattaaagaaagtgatgactatggtggctatcgagcaacaatttcgtgccaacttgagaatattaaacaagttatccatttggatattgcgacaggtgatgttgtaactcctcagccgataacatacgactataaagctatttttgatgaagacaattttccaatcattgcttatacaattgaaacaattctagctgaaaaactccaaaccatctattcacgaaacttcttgaacagcagaagcaaagacttttacgatgtttatattctttcaaaattgaagaaaaaagatattgatttcaatcagttaaaaaatgcttgccaaagaactttttcctatcgcgaaactgagctcgatttcgaaaaaattattgaactactcgagagattcaaatctgatcctactcagaatcaacaatggcaaaattattcaaaaaaatatagttatacaaaaggaatttcacttgcaaatgtgcttgatgagatgattagtcttattacaattattatttctactgactctgattaaaacttttaactgccccactaggtaatcgtgacattaaaggaaaaggatatgctaactaatcaagttattgttagcatatccttttttatttcgtcgtataagcaaaactcaagctactatccactccagataatttacggaaggtatagtttggattgccattgtagttggtttctgagataaggaatgaaccgtctgggtagactttctccacaaaagccacatgtccgtattctgttggggtgccatgtcctcctcccgcaaaggaaaggatagctccttcttgtggacttgtccctgtctctccaccgagacttgcggctgttcgtacccaatcttggccattgcccatggtactgataattggaatcttctcaccgtttttacctttgagttttagacccagttgattgatacgggctgcgactccccaagtacattggccgtaagcgtaacccataccgtcaccacctcctggaatagagttttcaaaaaggtcttctcgtacagcttcaagtgcttttggatcgctttgtgctgtcccaccgttaggttgactaaagcctttttcaatttggtaataccactcactggctcgtgtttgacgttcaagtagcttatcaccactatttccttcccagtaaatgagaaagagctgggcaagactagctggactgcctgaatttttgaagaagtcctttaaccagttggtgtaataaggactatccccatacaacatgaaatccagttgtaagcctaagtcataccatttttgatgttttcctttggcatattccaacaataaagtatgtctgcgtgaaccatccgcggtatctgtccattggcctaagcctaaaccacgtttgagaatatttgggtaacgtccattgtatatagttggaccattaagtgtgagccagccctcatcatcccacgaactatctgtcgcaccaacaggtggagataaatagtcgccttcagctcgttttggattaatggaggattctaccgaccagttacctagaatggctgcgatagcttgattggtcgcacctttgcttttaagatagtcataaattgccttggctctctcgaactcatcgccgccaaactgaccgatagttggaagaatggtggtctgaacctgaatcacttttggaaagtagaatgctggattgacatagaccaacttatccgtgtcatcatcaaccttttgataggtgacttttagacccgttccgtctttggtctgaccaataatatctcctgccaagacttgttgattttcactcactcggcctgaatgaatgccaaacaaggttagtttagtcttattcactcccttaccagatgtcaaaacaacgttctctccatcaagagataccttgccatccatcggagctacaatgacttgaccttcttttgcttctaagatgatatgatgatgaagcgttggtttctcatcaatgacctcataaccatatcggtaggtcatgcttaaactatcctcatcggtctgtccctgaaagggattgtccaattcttgaagggctaaatagttgccttcttcggtcaattcgtttagttcttcttggtcctcatcagacagcttgtaagcaggttctttatataagtcagacatggatttaatagaatctccaccgtttaagtccgaccacagttgactgagaaattctttgtaggttgttccgcttgtctctatgaaatcatctaacttgtagtcttggtattgatgattcatgtaaaccatgacctcatcaatcttagtgtaaaaggtaattcccttatcgttggttcttgtatgttccgcatcttcccacgtcatgtgggtataactcttactcaattctatttcatcttgttgtatgacactactacctgaaacactcatgaaaaagctcatcatcaaaaggagtatcaagagaatgcctgagacaatccaagtcaaaggatttcccgcaaggacagaaaagaaagtcatacttcccttaatggcttggacgattcctttaaaacctgcgacactttgttttctgacatgatttaaaaaggtttggtagcgtcttcttggtttaagaggtttctggcgtgtgaatccttttccctttttgaagttctggaatcgttcctttccatgagaaaattttgttttggtaaaccgcacaccagtctgtccactttttactgccaccttacctgcttgataagtaaacctgccatagcgtctggctttcaaactagtatccttcatggttcttagaccatctaaatcatcctcctgtgctatcaggtcaagggattcagatgcagccaagcctaatccagctttgactttggtagagtttttcttagtcttttggactttcttgagttgtttaacctcacgcttggcagaacttacgtctttttctgcacttagccgatcaaatgatttttcttggtgaaactgaaagcgagacttcagggaaggattttctttttggaaagtaaacttgggattaactacctgctgtttctcacttagtttcacttctgacagatgttttcttgccgtccgcaaacgttcttgagcttgcggaagtcgatagttcttgatttcctttgccttcaacagtctaggagaaacataggtaatttcctttatgaacttctcttctgcttccttttggctactgagtagatttccttttaactctgttttcttttcctgaaacagagaatttttggctgattttcgaaatcttccttttttaggaacagtctgttttaaggtcctaacttctttccgataatgcatacgagctgattttaagttgcttcgaaagttttgcctagcctgtttgactagctttttatcctctttcatctcatgtcctcattttttcagggtccgtactcatgatgtcaaagagcttggtgtgttgcggaatcttattcttgaacggaacaacggtggaaccggccttaattaagcctgcccctttttcaggattgaccaagtacttctccagctctttagaaagcccaagcatatgcaccaattcttcgcgatcgctcttagcctgttttaaaagaatcatgaactcgctattggcaataatgcgtctgccattggcatccaaaagaagcgtttctacattctgagtaatacctgtcggtatcgccccatacttacggacacgactccaaagtttgaaaaagaaatcagaggcatacttgtccaataagagtagctgcatttcatcaaagtaaatccaggtcttcttccctagcttttggtttttgaccacccgattccaaatttggtcaaagataaccatgagggcaatttgttttaactcatcgcctagctttttgacattgtaaatcaggaaatgactgtctgttttaatattggtccgatgtgaaaatatgtccagcgacccttccacatagagttccatatccagtgccaagtccttagcttcctgttcaggttgttgagataagacaaagacccattcgaccaaggacggtgtgtcaaaatgcttatatgtcaagcgtgtcacacgatctatcaaggatttttcacgaccatccattttgcggtccaagagctttccaatccaagacaagagaaattcggatttgaccttaactgggtcctcatccatattctcatcagatagttctaagacatttaagaaggtggtagagtctggggcaatatcaatactctccccaccaaaggcttgaccgataatactgtactcattttctgggtcaacaataataatttcagtatcactatctgcttccttgagcttagttgagatgatttcgtgttttgtcgccatccctttgccagctccagaagtccctaaaatcaaacctgatggagtatttaacttgccacggtcaatactgatgatattacttgagatttgattgatgccataaaatttcccacccttgtcatgaatatctacggaagtccaaggtgcattcacggcaatatttgaagtcaatagagaccgagaaacaccttcgagatagttcttcccaaatggcaagagactattaaaggcagcttcttgcatataggtcaagttatcaataatcatatcattagaccctgccacttgcttgataatatcaagagattgtttgagttggtcttcagtatccgctagcacgccaattagaaatacggtgtcaaacagtttatctcctgtttgggtcatggtttgaagaagagcttcagcttcatcgatgttgttctcaagaacatggccgaccttctccaaatagattccagtccgagccattttttgttgttcaccaatcttttgtgattccatcaaggtcttcttggttcgtagcttggtcatggtttcagacttagtagagcctttggcatgtaggctaatcatcacttccaaatctgactgcatgaggtctcgaataaatttatcccctaactccatgccatagtcgcgaacataaacaatctgtaataatcgatcgtccaattcaatatgattcttgtgtttaaaggaaaggtaggttggggcaataaagtgtttggtggattgacctgagagagtcaaatccttataagaaaacggtaaatgattttcacctcgtaacatatccgcaaggacattcactcgctcctctccaccaagtaaaccaagagatacatcaatctctgaaaagccactcttgaaatattccccaatctgtgacagagaacgaaaagctagttttggtgtttggtcgctcttgccaaatgaaagaaacttgacagctgaaaagttgttctcacccgcctctaagttggcatccatcatgcgattcaattcatcacgataagtatcaaacccatcttcctgcaagggatagagaatactcttacgaaatttttccaaattaactttttgattgaaaatagtcagttggaaattggtcttatcatccagtgaattgattaaatcggaatatttctccacgatagctcccttatcatctaagccaactgtttggtaattaacatctcctaagagataggtttgtgagaaatagcttggactgacctgcataaggccattctgaaaaagtccttgataggctaacgtatttacggtagaagggctgatttcctgtttctgtgttttcgtcttttgctttttgtcattagaagaggtctttgatttcattgagtgttttaattttttcacgttggtctccttttcttccagtaaatgtgcggtctggcaccgttagttcataatgaaaacggtacttgaggtatatttcaaatggtaaatcgttggggcgatagaccccaaataacatgagtggaatggtaaagctaaaaacaaaaccatagacaaaccaatccccaaattgccaataaaataggttcaagcccaaaaccaaaatggttagggcgacagctggaaatacaaaaataacctgtctagttgtaaatcccagccatgccctgtgttgaacctttgagatgtccttaaagacacgtgtgttcataaatgttctccaatctaaataagctataaaaagaggaggcgagatagtgactcccttcctcctacatccccaaaatacttcgggcggttcgttgactgccaaccaaggcaatgattaacaatatggcctgtaccaagccaccaaacataatggcgagtgattccatcactccagctccatttgatacggcaatctttccagccgattcaaacaagggaacaagagatacaattagaaaaatcaaaataccttgaacggcatagaccatgatgtttttaaggtaaccaatcccaacacttctccagtcatcactaaggaaggtcggaatggtaacaggggcaaaaggaatcatcagatagagttggataaagcgaatggtaatcaagatattgacaaccataatactggccattcgtaccaaccaaatgagaatcgcaaaaaagccaataatcatttttcctacaattccagatcccttaatgcctgagatggtatcataattagcaccaccattcgtgacaagacttgccacttgttcaataacatatgaggcaatggcaataatggcttccacaataaccgtcgtattggtaatcacgaccgcgaccatgatgtagctgacaatcataggtgctatggcttcaaaggtcattgcaccgcctgagtttgcgattttcttggccatttttgaaaattcgagtacaagaactaccgcaagaatagctactcccaagggctgcataatacccttggtaatggctgtcatgtaagaccaaaccgtcggattaaagtccgccagtgacttaaccaagttagcagttgattctaaatcgacctgaaacccttcaaaaaggctatcgcttgacactttttcagaggctagaaatacaaaaggtgacgtaaaattcatcatcatgtcatgttctgacctcctctaaatggtaatctgtgtcacaaaagcacctgcggctcccaccatgacaccaccaacaatttctaaaatggcatttcggacgcctggcccaccatctttaatgttggttgaaaggttgataatgcccatgactacaagaaaggctcctactgcaatcaagcctttttgtaatagagacatggcctgggagaacatggagctggcgtccactccgtaaacaaagcctgttagtttttgattcatatttttcctcatttctattaatgtagtgacgtttctgtgcttaaatcccttatttgatagtctgacaagtccaattcttcctctttagccaagggattgatgtgatagttccaccaacggtcatcggtttccttatcagcgagcaacttccaatgtttatgtttgagaggaaaatatttcttggttcgaaaaacaggaacccctgcaatgcgtacgaggcactcatctcgtttcatagttccaacttcatcagccgtcatcaagtcacgagcaattttctgatgagaggtagaacttgaacccgtctgcccaaaagaacgactggtgcttctgacatcaacggtttgtttgcctaaaagtccactcatgaatttgaaagtttcctcgtcattcccacccaaatagaggagactgtcacagttccccagtatagttttccaagcttctttttccttataaagtccttggagttgagcgatattttggagaataggcacaagactcatattcctagagcggactgttgaggtttgttcagcgaagtctgggatttctccgacattcgcaaactcatccagatagcttctaacatgaataggcagttgccctttaaagtcaacatcagcctgtctggtcaaagtggagaaaaccgtagagaaaaataaagcagataggaaacgaaaggtcgtatcattgtctggaataacaagatagaccatggtcttttgagtgccccacgttttcaaatccatagtgtctctttgcgtcaaatcaatcaccgattgaatattaaagagggcaaatttagctgttgtgaccgcaatcaccgaatccaaggtcttatccttatagttttgaaaatctgcccagtttctcatggtaaagttctcatgaccatatttcttagcatagtcttcaaacaggacttcaagtatacttttgtcctgattgtctccctttgataagagtttgatgagtttcccaatctcagaaaaggctggataacggccacgcttacgtcttgcttcctgctcttgcttagaacttcctggaggattgtaaaaatccaccaagtaagaggcaatagctctcaccaatgtcatggaagcctcatcccaaaacggatcactgcgagaaccatttcctttggtattattaaaatagaccgttaacatacggttcaaatcattctctgtttctacataacgaaagggattaaaaccgtctgaattggtcatattaaccaagtctaaaaccttaacctgataaccgttttctaaaaagagtttacctgtcttctcagccaaatggtctttcggatctacgacaatattggaacagttaagttggataaggttgggtttcacaaagcgaaaggtcttacctgccccagaacccccaatgacaatcaaatttttatttcggtcaaactggggtttcttcttttccaacaaggttagacgaacatcacgagccaaaatcgtgtcattgaaaggattcttactgtaaaagttccgcttttccttactggttccaaatcgtgcagaaccatattcttccccttcccgatagactttctgtcctgtcgatacataaagatagactagcgtcatcattagaaccccaaggataaaggcaagaaaagatttttgagtaaaggaaaatagccataaaggattgaaaacctgatttaacccctctcctaagaggtaggcaatacgttccataggtggggcattagttaaactatcatagagtagggttagacgatggcagaaatagccaaaggcgagacccaagagtccaaagacaaatgctttttgcctggaatacattacaaggtcacctccttggtttttactgccgaaagttctgtcactctaattttctctttggccagttctatctcttggtccaaggttttatcaaaggttaaaccttctagcttctctggattagacatcagtttcttcaacaattcatccaagtgatgatcgagcaaggtcttatccttggcataaaagtagagatagtctttttgccaactaattgcgattggcagtttttctgactccatcaactccttaaatttctccacatcgattggcttatccagtatgtctttactaacatcaatcgcttcaatggcgtaaggactttgaaggagttcttccattttttgaaccccaatcttataagctgaatcttgagctaaggcttgcctagccgaccattctaagagttttaagagggttctgactgtcaataaactacttctttctacgtattgcatcgcttgacgttcttgttgttcagatgacatagtggcctcctcttttttcgattccctatcaaacataaggtgcttccataatacggaagcactcttgattttggtatcacaagaaagttacgacataagccaaactattccaaagtaaatgtaaggcgattgccgtcatacaatcagttttcaatcgaacaacagccaaggtcaagccaagacagctatagatgagccaactccctaactgattaggtccatgggatagaacaaagagaaaactggtcacgcctatttgttcaaaagggaatgtcaatttttcccacagcaattgcctgtaaacaatctcttcaagaatacttgcattgaccagaaacaataaaaagataataggaggaacctgttttcctacttgtaccaatactgcttgattcctagtctgaactggaaataggaaactgatgaagactgcaaaagcaaccatagccacaaagccaagaagcaaccaacttaggcgattttgtacgcccacaatttttaatggaacagttttatgacgggcaatctctaagcaagtcacacttaataggaccaattgtagcaagactataccctctattgtcagatactctttcaggaataaactcaccagaagaccgttaagctgtatggctagataaaacaacactatccttatcattgtcacctcttaaataaatcttcataatcaatatctaagactagaacaatacgctcaacccatcttatttgtggcatcagacgattagatttgtaatgccgtaatttttgatagaggcgattaaattcacttggataaacatattgaccgttgaatactttgcgagctagttctgcccaagtgaggtctttttcagccagaatgatttctaaattgtcccaaaatcgttcattcatcttcacacctaccctgtcacttgtttcatcagactggcctgaaacaactcttcttttacctgtctgggaagaaaagtacgtacttcgtctagcccaatagctggatagacgtgattctgacagacaatgagaggcagacgaaggttttggtctggcttttggagaatgagctgaatcatctcattcaaacttatcgaatattgacttttaaagcgaagaaatcgtggcgacagcaactcaaaacaatccgtggttttggcaaagagtgacagtatgatttcacggtttacctcacatgcttttgtacaacgataagccactccataggtcgtcaaaatggttagtaaatcttgatttgtattggtattatttcctagatatacctcaagcataggcacctccttatagggttaggctattttcaactgttggttcaggagttgagaaatagcgactcatatcaatgggcatccgtccttcaccaaagcacttgaccgtcactagagtcgttaaaatgccctcctttcccctagcagaataattttcaccaaaggcacgaaaggccaggtgattgtctttcgtcaatagtgtatctacaccatttttaatatccctagtttccataaaatccgaaatctgatgaagattggattcgtagaataggggatcattcatctctttgtggtaatcatcttcaaaagttacctcaaagtcacaatcaaaattggggagcgacagtatcttttgtaatagctgattggtttcagcttggtgaatacgttcttctaattcagtacaatctaggatacttttcttatgtagtaagttcatgtttttcttcctcttccgttcttctaaattctctggcaatggcttcaataactgtgacagtcacgctattgccggcctgtttgtatagttggctcttactagaaacactctctgctctttcataagcccaatcaggaaagccttgaagtctgaagcactctcttggtgtcagtcgtcttattctcaggcgataaagtttcccctctaagacaatgcctgtgacttcataccacttatcctgtcgatattccagagcagcaactactactcccatattgtctgaagtcgtcagagtattggatattccctttcccacacgtcccctacgtttggttgagtctggataagccagattgacagagtctccaagagttgcctttgcgtaccctgttttagtggcttccttgattttcagaaatggcagctcctccctcagcaaaatctttggcaccttgtctccaccttgcatggtggtcaaggtcggtgacaagccagaaatgtcaaatactctaccggtctggtcaaagctagtcggcagatttcctgcgacaacaactccgtgtttgtcttgactggtcaaagtaaacatagggtcttgattgtccttaaatcgacgaccatgttggcgtttttctagtctatctggtgttaagactggaatggcgatttttgcaccctctcctttacctcttgttagtgtaggagcaagtccactcgtcagatagacttcaccattcaaaccatgtttagagggattgatatttcctagcctttcaagatgagctgggctgtcttctcttctgagaggaaatatgaatctggaacggtatcttctagaatgtccgataataaagacccgttctctgttttgcgggacttggaagtccttgctgttaagcacctgccattcgacatcataccccaattcatccagcgtggagaggattgtggcgaacgtccgtccctcgtcgtgattgagtaggcctttgacgttttccaaaaatagaaaacgtggttggatttgtttggccgctcgagcaatctcaaaaaagagagtccctcgagtatcttcaaatcccaatcgtctgcctgcgagtgaaaatgcttggcaaggaaatcccccgcagatgatgtccacttgccctctaaattgtctaaagtcatggtctgtgacctctttaatgtcatggtattctatttccccttctgtgttaaacatggctttataagatgttctagcgaatttatcaatttcacaaaagcccaggcatttatgaccctgtgattccatccctagcctaaaaccgcctatcccagcaaataaatctaaaaatttcatttttcctctctttccaactaaaaaagagccttacacttgtaaaactcttgcttatatatgatcatccatttctggtgcacggatgatttcaacaatcaaaatgatgatagaaatcagatagattccacctagtatccaccaaatcatcttattcacctccttttacttcttgtcgtctcagttgcttggtccactccgacagcacaccattaaatacgtattcagctattacttcggctgaccgagcaaatcgcatttgttccaatgcatactgataccggtcactaaaataaatcatggcatagtcactagcagactgagatagacctgtctgtcttaactggtcatgaaccaaaccccaaatatagtctcgatcgtacttggtcacgccatcgacttttgaagtaaagttttcttcttttttctcatctactagctgcctctcctcctcgtccttcataactaagtcactcccttcagtttcactatatttagtctcacttccttcagtctcactaggggctgaatataagaccggccccgtctttctttgagactcccctagtgtttttttaacactagccccgtctgtatgtaagactggggtaggttcatgttctaattcccccaagtaaattttatttgccattcgacctctttcactagaggactgttggacttcatcaattaagccatattcacgtaaggttttcttgatagagagtagttttgactttgaacagcctaatagtgccatcagatttgaattggaataaatcaaataaatagccccatcctcatcaatccagcctttactcaaagacaactccaaccgatcttttaaaaccgcgtaggctaccttaacttccagcttcatatccttataacgttcactctcaaacaaaattttagggagtttataataacgctctgatgtctgatattgattagcggtaatacgtttcatgattgtccctccaagactaaaagtccaaaattcccgaattcatcaaatcggattaaacctgtttgttccatttcatttaccagttgagttgcttttagattatcaactcccatgatggtcatgatatggctcttcacgatatgacgtgatgactgttcttccttttgcataattacctccaaaacgcaaaaatggggtagacaatctagtgtctacccccgaaagtttattaaaacaaaaatcctgccaaagaatttttggcaggatttttggcaggaaaccaaatcaatttatcagtttctatcaatcgcttatcgctctcaaagactggtaaatagggattccgcaatctaattatgatatgactcttatttaagagtaactgaagcacctgcagcttcaagtttttctttgatttcgttagcttctgcttctgaagcaccttctttgataactgatggtgcgttatcaacgatagctttagcttctttaagaccttcgcctgtgatttcacgaacaactttgataacgccaacttttttgtctccagcagctgttaattcaacgtcaaatgagtctttagcagcagcagcttcaccaccagcagcggcagcagctacaggagcagcagcagttacaccaaattcttcttcgatagcttttacaagatcgttaagttcaagaattgtagcttctttaatttcagcaataatattttcaatgtttaatgccattgttatttcctccaaaaatatgttttaatataaaattatgtagctaggctacttgaagagtgcttatgccacttcttcgtctttttctgcaactgctttgacagcatatgcaacgttgcgtactggcgcttgaagtactgaaaggagcattgaaagcataccttctttgtttggtaatttagcaagagcgttaatttcttcaactgaagtgaatttaccgtctactgaaccacctttgatttcaagagcttctgcatctttagcgaaatcgctaataactttagctggtgcaataacatcttcgttagaaaacgcaactgctgatggaccaacaaaaagttctttaaggtcttcaagacctgctttttcagctgcacgagttaaaattgagtttttgataactttaaactcaacatcgctttcacgaagtgaacgacgtaagttagtatcttgctcaacagtaagaccacgtgaatcaacaacaacgatacttgctgctgctttcattttctcagcaataagttcaacttgttcagctttttttgcaataattgcttcactcattagttttacctccgtttttattttttgggataagcacaaaaaaatcgcacctaaacctagacacgaaagtacaatacgttattttataatgacgttttgtgcctcggtaggaatattatgagcactgctcccctactgtcttaggtcagtttcatcagaaactttaaatagtataacttataattctagcattgtcaataatttttattatttttctgaaataattttatagtaccaaaaaatactaaaatagttatctttatatcaaaaaaataatattttagtatttatttattgacctttactgactaaaggtgtattatagtaccagaaagataattaaatatttaaattagacctctctatatgtattaaagtataggaatcaataattaactttcaaaaattaaaatcaattgaggtatttaatatatggcaaataataatttttataatcgtgacccttttggaaatatggatgatatttttaattctctaatgggaaatatggggggctataacagtgagaataagcgatacctaatcaatggacgggaagttactcctgaagaattcagtcaatatcgtcaaactggaaaactccccggtcaagagctaaataaccaaaacactcctacaaaccaagtctctgcagatagtgttttgactaaattaggaactaatttaaccgatcaagcacgtcagcatttgctagatccagttattggacgaaacaaagaaattcaggaaactgcagaaattctagctcgtcgtactaaaaataatcctgttctggttggtgatgcaggtgttggtaaaacagctgttattgaaggtttggcacaagcaattataaatggtgatgtccctgctgctatcaaaaataaagaaatcatttcgatagatatttctagccttgaagctggcacccaatataggggtagttttgaagaaaatattcaaaatatcataaaagaagttaaggaaacaggaaatattattctcttctttgatgaaatacaccaaatattaggagccggttcaactggtggtgatagtggctctaaggggctcgcagatatacttaagcctgcactttcacgtggtgagttaacggttataggtgcaactactcaagatgaatatcgtaacaccattctcaagaatgctgccttagcacgtcgctttaacgaagttaaagtcaatgcaccttctgcacaagatactttcaatatccttatggggataagaaacctctatgagcaacatcataatgttgttttacctgactctgttttgaaagcagctgtagatttatctattcaatacatcccacaaagaagtctccctgataaagcaattgaccttattgatatgactgctgcacacctagctgcgcaacatcccgtaactgaccttaaatccttagaaaaagaaatcgctgagcaaagagacaagcaagaaaaagctgtcaatactgaagattttgaagaagctcttaaggtcaagacacgcattgaagagttacaaaaccagattgataatcataccgaaggacaaaaagtcactgcaactatcaacgatatcgctatgtcaattgagcgtctaactggagttcctgtatcaaatatgggtgctagtgatattgaacgcttaaaagaacttggcaatcgtctaaaaggtaaagtcattggtcaaaatgatgctgttgaggcagttgcgagagctattcgccgaaatcgtgctggtttcgatgatggtaatcgtccgattggtagctttctatttgttggaccaactggagttggtaaaaccgagctagcaaagcaattagcttttgatatgttcggatcaaaggatgctatcgttagacttgatatgtctgaatataatgatcgtacagcagtttctaagctaattggagcgactgctggttacgttggttatgacgacaatagtaatacactaacagaacgtatccgtcgaaatccttattctattgttcttcttgatgaaatcgaaaaagctgacccgcaagttatcacgcttctccttcaagttctagatgatggccgtttaactgatggtcaaggaaacactattaactttaaaaatactgttatcattgcaacctcaaatgcaggttttggaaacgaagcatttacaggtgacagcgataaagacttgaaaattatggaacgaatttctccatatttccgtccagaatttctaaatcgtttcaatggtgttattgaattctctcacctaagcaaagatgacttaagcgaaattgtagatttgatgcttgatgaagttaaccaaacaattggcaaaaaaggaattgaccttgtggtagatgaaaatgttaaatcacacttaattgaactgggttatgacgaagcaatgggagtacgtccattgcgccgtgtcatcgagcaagaaattcgagatcgcatcacagactactatctcgatcatacagacgttaaacacctaaaagctaatttgcaagatggccaaatcgtcatttctgaaagataaaaacaaaacccgtttggaagaatccaagcgggttttctagtggattgaaaaaggaaatcaaacttaccctaaccttcttcaagatactttacttattttaaatgtgcagagaggtcagcaatatcagctggtctagttcggcaacaacctccgacaacttgggcgccaagtttttgccagtcacttgtattttcaagtagggtgtgtgaatgatcagggctagattgccaagattggcttgccccatcataaacctctccagagtttggataggtcacaagaggcttgttagtctgctctgctattgcttgcaagaaatcagcaactaacgatggacttgaacagttaatgcccagcgccacgacctgtgggctaacatcaatagctttcgccaagtctgcaacagcactaccatctgagatggtcttaccatcttgagaggtgaatgacatataagcctcaacctgagggaaatcctcggcaagtagctcaataagagcctcagcctcctgagcgtttggaatggtttcaagtgccagaatgtcaacaccctcatctaaaagaagctcaatacgatggcgatggaagtttttaagaccttgcttatcaatatcgtagagtccagtgtactcagagccatccgctaaaaaggcagcgtagggaccaacatccccagaaatcaaaggatagattctctctgatttttcttcttttgtcaaacttttccaaacttgctcacgcgcagcttttgccaactgaacagtcaagcgaatcaaatcttctgtctgactttcagagacaccaacttgagctagtccttgtaaagtcgcctgataagttgatgtcgtcacaatatcagcgccagcacgaatataatcttcatgaatggtctgaatagctgctggatcctcaatcagatatttggctgaccaaagtttcccagaaacatcacaacctctactctcaagctcggtccccaaggcaccatgtaggatgagagtttttttactctctaaaagttctttaaatcttcccataagatcaccatttcttgtaacgtagtttgtgataaatatagcagaaaataataaatggaacaccgaagtaaagcccagcacgttgtgagctatcccaagcaatccctacaatcgaaatcaagagcaaaatgattgtgatataagggagaactggtgtaaaaggtgttttgtaagacaaatcttctagttgattctctttcaagaattccttgcggaaattgatttgtgcgactggaatggctagccatacgacaacaacagcaaagcccgcgattgaaaccaaggctagataaactgtgtctgcagcgtaaatacttgaaaagagcgacagcactgctcctgccattgacaagagaagagcacgcattgggacaccgtgtttattgattttcacaacagattttgacaacataccttcattggcaagggaccagagcatacggcttgatgcgtagagacctgagttaccagcagacaggatggctgtcaagataacgaagttcatgatatccgccgtaaaagggattcccatcttgtcaaagacatcaacgaatggtgctgtggatacgcctgcctctttcattggcaatagcgaagctaggacaacaattgtcagtacaaagaaaacaaccaagcgaccgattgtcgttttaatagcccttggtacagcttctttgggattatccgtttcaccagccgcaataccaattaactcagtaccagagaaggcatagttaacagccaacatgactgagacaactgcaacgataccatttggaaaggcaccattggcagtcagatgagtgaagagaatagccttgtgctgaccttcaaaggaaactagaccaaacatagcacctaagcccaagataataaagataatgatagcaataaccttaatacttgagaagaaagactctgcttctgcaaaaaagcgtacgctaagagcatttaaaccaaaaatcacaagggcaaaaaaggaagcaaatgcccaagccggcacatttgggaaccagcgctgcatcagcatggcagcacctaaaaattcagtccccaaggcgaccgtccaacaaatccaatatagccaagcaacagtaaaacctgttccaggactgataaacttagtggcataagtgtggaatgaccccgtcaccggcatggcaaccgccaattccccaagtgatagcatgaccaaataaaccacaacggcaccaatcaaataagacagcacagctccaagcggaccagcctgtgcaatggtataacctgaactcaagaaaagcccagtcccgataacaccacctagcgataacataaagagatgacgactggtcatcttacgctggaatttaccttcatcttcataacgatgattttccataacaacctccaagaaactaatacttttatcctaccacaatctagtcgtattggggaataggtattagctatcatatatgataaagaaaaactattacaaaaaatcagcgaatcataaatagcggtaaccttatttttttatccttacaaaattaacgaccttatgaaaacggtccatttgccaaggactaataatataattggtctccttatccttcaatagctgtacaggtgcaataatgctagttagtacacagacaatcaacatgataaaaccacctagccaatctccccaagtgagcattccttctgcactagcttgatagatgtatacgcaagctattggtactaggagaaatactgtcgttgctagaccaggattataccaagttttaagtttaatattcatctgaaaaccatgacccaagagctgcgttagactaaagaacatgactcctaatccaagccaataagcttgaggaaaagcaatactagcaatgtaaagcaaccaagcaatagtattaaccaacataatagactgagtattgcctggaaaacaatccatcagctcttcttcatcataaacaacatagttaatgataggtgatgccccaccgggaaactgatattcttcaaattgatgcgctagaagtgccataaagtaaaaatacaatagatagtgaagcattgaccagtcaggtctaaaaacaagcaatattactgctaaaataataaataaaattgctccaaaacgataccagtaatttctaaaatatgacatgataatacctcctatttaaactgtgtttcacgaaaatgtgttaaaaatggttttgagcgtgaaagatcaacatcactaaatgcgtaatttgaatgtcgacctaaacgcttatagattggggaacgaaaggctataaagtagttaagaacaatccatatcagcctaaaaaccaatcaagtccagaatacaacttccaatcatgagctaaataatagacagaaacagggacaagacctactaaggtcgtaagaagtcctggattataccacttcttcaaggaaagattaaaaaagaaaagatgcatggcaagttctgcaaatgcaaaaatcatgactgcaagtgttaaaaatggtatattgggacaaaaaatcggcaaaagataaacaatcactgcaaaccactgattcccgaaaaaggctgatagatggtttaagtcccacttactagtatcagtttcaaccgatttaagttcaactagcatagtgataagcggaaaacctccagggaaaccaaattcttcgaaaaagtgtaattgaataaaaagtcccgaaataagtagtgactgcactcgtaaatcccaatttccaaaaaataatgctaaggcaaaaagagaagcaagatagggacaaaagaggtaccattttgttatcaatgctttcataagatgacctccaagatttgtgacatttgataccatatagtataatcaagtgaacctataatatcaatacctttggaggttttatgcacaaatgactgaaagtgtgacagttaataaaaagagaataaaacaaatcactcaaacacaagaggatatcttaacagcttttggccaacttttggaagagtatccctatgagaaaattcagattagccaaattgccaagaaatctggctatgctagaaggaccttttaccgacactttgacagtcgagatgacctacttacccttttcatcgaaagactaacattaaatctctttaagcaacttggtcaattggagcaacctacttttagccaagttttccaaaatttttttagttattggtctgattataaatcccttcttctcattcttagaaagaatgacctactccctcaatttcaacaatcctggttccgacatattgatttgatagagttaggtcgtggtgatttatcttccaatacctatgctcagcgatttgcgattggtggtattttcagtgttctaattgagtggattcatcaggactgccaaacaagtatcgaagaattaactcaactttccttcgatattatcaatcatttaaaaaattaaaaagagctttgcagtagtctcaacagctactgcaaagctctttttgtcataaactctcaaattataactcagataaaatagtatcccatgattcatcaagacctgtgcggtcaacagatgaaaagacgatgaaatggtcctttttatcaaagtttaatttcttcttaatagacgactcatgtttattccacttgccacgaggtattttatctgcctttgtcgctacaataattactggaatctcatagtacttaagaaattcatacatttgaatatcgtccgcacttggatcatgacgaaaatcaactaaactaacaacaacacgaaggttatcacgtgttacaaggtactcttcaatcatcttgccccacttagcacgctcagttttagacaccttagcgtagccatatccagggacatcgacaaaacgcagtttgtcatcaatgttataaaagttgagcagttgtgtcttacctggcttactcgacgtacgcgctaggtttttacgaccaagaagcgtgttgataaagcttgatttaccaacatttgaacgaccagcgagagcaacttctgggagatcatcctgaggataatgtgacttgttagctgcactcaataaaatagacgcattatgagtatttaaaaattcttctgccatctctatctccctaagccgtctctaaaacaggcttgtcagtaccctcaacagcagcctttgtgatacgaacttttgttacatcttcttggcttggaatttcaaacatgatatcaagcatcgtttcttcaataatagaacgtaaaccacgtgcaccagtcttgcgctcgatagccttatcagcgatagccaatagagcatcctggtcaaattccaattctacaccatcataagataataaggtttggtattgtttaaccaaagcattgcgtggttctgtcagaatacgaaccagatcttctgcagtaagaagttctaacgctgcaactactggtaaacggccaataaactctggaatcagtccaaacttttgaatatcctcagaaattatctcttgcatataagaagcgttgtcatcaattttacggcttgtctgtccaaaaccaataactttttcgcctaaacgttgcttcacaaggtcttcaataccatcaaaagcaccaccgacaataaaaaggatgttcttggtattaatttgaatcatttcttggttaggatgtttacgcccaccctgtgggggaacacttgctaccgtaccctcaataattttaagaagggcttgctgtacaccttcaccagacacatcacgtgtgatagaaacattttcgcctttcttagcaattttatctatttcatcaacgtagataataccacgctcagcacgttcgacattataatcagcagcttgaatcaatttaagaagaatattctcaacatcttctccaacgtatcctgcttcggtcaatgaagtcgcatctgcaatagcaaacggtacattaaggcttttagccagtgtttgtgctaagaaggtttttcctgagccagttggaccaatcatcaaaatgttggatttttgcaaatctacatcatcgtcactactctcggtataactaacacgcttgtaatgattgtagacagcaactgctaaagcacgtttagcacgatcttgccctacaacatattgatttaatatttctaatagttccttaggttttggtacttctgctaaatcagccagtacttcctcagctaattcttccttaataatttcttgtgataaggccacacattcattacaaatgaaaacaccattacctgcaataattttttttacttcatcttggcttttgccacaaaatgaacaatagacattcatatcgttattacgattcccagccattttttcctcaacttttctattcatttaatttaaaataatgttccataaaaggcatggattgtgttgacaaggttagtgaaagcattcatcaaaaaaactgttcctaatccatatctttttttctttatagcaggaattgcacataaaacacaaatcacagctaaaaatgcggtaaagaccccaaaaaggctacgttgcattgaatagtattccttccttatttttcaaaatatgtcacagtaaaagcatgagcattctgctcatccttttcaaaataatctctagagataactttaaactcagatagattaacatcaggaaaataggtatcacctttaaattttccatgaactttagtttttatgattgcttcacaataaggcagaaatgctttataaatacttgcaccacctacaataaataaggtcttattatgttcctgaaaccattttataacttgttcaacactatttaggactgtcactccatctgcttggaattgttcatcttttgttaagatgattgtctctctaccaggtaaaacacgacggttcattccatcaaaggtctttcgtcccataagcaaagcctgccccatggtcgtttctttgaagtgatgtaactctttaggaagcctccatggtaaaccgccattaactccaatcaaatggtcttcatcttcagcccaaatggcaattatttgctttgtcatgacttttttcctcactaacttatctctagatattctaacaaattttacctcaaattgcttgttaaaaaacatgagatagttagattgctaaatcaaaacgtaattgaggtttaattgggtcataatcaactaacgcaaaatcatctggtttaatatcaaaaaagtctgttccatctggaacattcaatactagtttggggttacactcagacggttggcgttttaagagttcctgagcttgttcaaactggttatcataaatatgaagattattgataaaatagaaaaacttcccaactctccaaccaaaatgctttgcaatcatcatctgaagtgctacatactgcatagcattaatatgatgtgcaactaacatgtcattagaacgttgtgttaatgtggcatccaaataaagctcaccattaacgcgtctcacatcaaacatcgtttgaaaagcacaaggtagtaggccttctgtttcttcaaatgcttcatagtcccataatgaaataacattacgacgattccaagggttatcttcaagctgttttaagagttttgatataatattatgttttttaacaactgcaccgtagcgctgacctatcgtgccagtatggccaacttcccaatcattccagtatgtcacaccatatttatcattcaaaactgctaaatcatttgtctgatcttgataaatccagaaaatttctttaatagcagattttattggaattggacgtagagttgtaataggaaattcaccctttgataaatcatactctgcaaaggcacctgtaatatacttagaattagccatttccccatttttatatctaggtctggcttgctcgctaaatacaccttcagacataattttcgtgatattgtctttaaataataaatcggcttttgtcatgagatacctccaaagtcttattttatcagattttaaaaagatattctagtgagaaacaagactttgaaggttaaagctttttttcatatttttagcttctttatggtaaaatggaatttagcaaaaatgacttttattcagaaaggtttaccaatgaaaataggaattgataagattggttttgcaaccagtcaatatgtccttgaaatgactgatttggctattgctcgccaagttgaccctgaaaaattcagcaagggattattgttagattcacttagtattacgccagttacagaagatatcgttacacttgcagcttctgcagctaatgatattttatctgatgaggacaaagaaactattgatatggtgattgtcgctacagaatcaagtatcgatcagagtaaggcggcttctgtctatgtacatcaacttttagagattcaacctttcgcaaggtcattcgagatgaaagaagcatgctatagcgcaactgctgctcttgattacgctaaattacatgtagaaaaacatccagattctaaagtattagtgatagcttcagatattgctaaatatggcattaaatctactggagaatccactcaaggtgcaggcagtatcgctatgcttattagtcaaaatccatccattctagagctaaaagaggaccatctagcgcaaacccgtgatattatggacttttggcgaccaaattattctgatgttccttatgttaatggcatgttttcaacaaaacaatatctagatatgctaaaaactacttggaaagtatatcaaaaacgttttaatactagtctaagtgactatgctgctttttgtttccatattccttttccaaaattagctttaaagggctttaataaaattctagataataacttagatgaacaaaagaaagctgaactacaagaaaattttgagcactctattacctatagtaagaaaattggaaattgctatactggctcattgtatctaggacttctatcgttactagaaaatagtcaaaatttaaaagcaggtgatcaaattgccttcttttcatacggtagcggagctgttgctgaaatttttaccggtcagttagtagacggctaccaaaataaacttcagagcgatcgtatggatcaactcaataaacgtcaaaaaattacagtaactgagtatgagaaactcttctttgaaaaaacaatcctagacgaaaatggaaatgctaacttcaacacctaccggactggcactttttctctagactctatttgcgaacatcaacgtatctacaagaaaattaataattaatatgacaaaaatttcctggacaggattttcaaaaaaatcccctgaagaacgtattcattaccttgaagaacaagattttttagctgattcttccctagaaatagtgacgaatcaggacttactctctttatcactagccaatcaaatggctgaaaatgtcatcggtcgaatagccttaccattttcacttgtcccagatgttttggttaacggtaaagtctatcaagtcccatatgtcactgaagaaccgtcagttgttgctgctgcaagttttgctgctaaaattataaaacgatctggtggttttctgacaaccgtccataatcgtaaaatgattggacaagtagccctttatgatgtacaagatagtcaacacactaaagaatctatattaaatcaaaaacagcaattattagaaatagccaacgctgctcatccatcaatagtcaagcgtggaggcggtgcttgcgacctaactattgagattaaagaagactttttgattgtttaccttatggttgatacaaaagaagccatgggtgctaatatggttaacaccatgatggaagcattatcttcgccattagaagacatttcaaaaggcaaaagcttaatgtcaattttatctaactatgctaccgaatctttagtgactgctacatgccgagttgatttaagatttctaagtcgccaaaaagaggaggccatcaagttagctcaaaaaatgacgatggcaagtcaattagctcaagtagacccttatcgtgctagcacacataataaaggtatttttaatggcattgatgctatcgtcttagctactggaaatgattggcgagctattgaagctggagcgcatacctatgctgtcaaagatgggcaatatcgaggattatctagatggtcttataaggttgatgataattgcctagaaggtactctgacgctaccgatgcctgttgcaacaaaaggtggatccattggtattaaccctagtgtccacctagctcacgatctactaggtcgtcctaatgctaaagagttggcaagtattattctttcgattggactagctcaaaattttgcggctcttaaggcattggttagcacaggaattcaagctggtcacatgaaacttcaagcaaagtcgttggcactacttgctggagctaaagaagaacaaatttcagaagtcgttaaacagcttctagactctaaacacatgaatctagagacagcacaaaaaattgtcaataaacttactaaaagtaaaaaaagaatttgagaaaaatcatctcaaattctttttttacttgacttgaatttccataagtgtataatctagttataaagactagattatatggagttttaaaatgaataaaaatcaatacccaaaatgggaagaattacctgaactagatttgtatcttgaccaagtacttctctatgtgaatcaattaattaatcctaaaacaataactaacgataaactactcaccgcttcgatgatcaacaattatgtcaaacataattatatatccaaacctataaaaaaaaaatacaatcgccgtcaagtagcacgattgattgttattacagcttttaaacaagtttttgctattcaagaaatcagtcaaacattagaacttctgacagctgacaatcattctgaagaagcatataacggatttgctgcttgtatgaacaaagaagaggttcacgatttaccaccagttgtcattagtgcctgtcagacgttgaacctttatcaagaaacacaaaaattagttttagaactaggaggaaaaaataaaaatgcttaaagaaatgtctatcaaattaagtcctcaactttcctttggcgaagagcttgcaaatagtatcactcacgctgtaggagctttgcttatgctaatcctattaccaatcaccgctgtctatagtcacaaccacttcggattacaagcagcacttggtacctcaatattcgtcacttctttatttttgatgtttttatcatcaagtatttaccactccatgacttataacagtcttcaaaaatatgttctacgcatgattgatcactctatgatttatattgctattgcaggtagttatactcctgtcgcattgtcacttattggcggctggttaggatatctcatcatttttttacaatgggggattacattatttggtatcctttataaaatcttcgctcccaaaatcaatgataaatttagccttgtactttacctcattatgggatggctggttatctttattttccctgctattatcacaaaaactggaccagctttttggggattactcttggctggtggtatttgctatactatcggtgcactcttttatgctcgcaaacgtccttatgatcacatgatttggcacctttttattctattagcttctattttacaatacattggaattgtctacttcatgctataaaatttaactacattttattgattatttttttgctaaaccatgatataataataatcatctaaatcttagagagaaggcgtggacatatgaaaagtgcttatatcttttttaatccaaaatctggtaaagatgaacaagcattggcaaaagaagtaaaatcttatttaatagaacatgattttcaagacgattatgttcgtattattacaccttcatctgttgaggaagctgtcgccttagcaaaaaaagcatctgaagaccatatcgacttggttattcctttagggggagatggcactattaataaaatctgtggtggtgtctacgctggtggtgcttatcctactatcggactagtacctgccgggaccgtcaataacttttcaaaagctttgaacatcccgcaagagaggaatctcgctcttgaaaaccttctaaacggtcatgtaaagtccgtagatatctgtaaagttaatgacgattacatgattagcagtttaacacttggtctccttgctgatattgctgctaatgtcacttctgaaatgaagcgtaaattaggcccttttgctttcttaggtgatgcctaccgtatattaaagcgtaatcgatcatattctatcactcttgcttacgataataatgtacggtctttacgcacgcggttactccttattaccatgaccaattcgattgccggtatgccagccttctctccagaagcaacaattgatgatggactttttagagtctacactatggaacatattcacttcttcaaattattgttgcatctaagacaatttcgtaagggagattttagtcaagcaaaggagataaaacattttcataccaataatctgactatttcaacttttaaacgtaaaaaatcagctatccctaaagttcgtattgatggcgatccaggtgaccaattacctgtaaaagttgaagtcatccctaaagccttaaagtttatcattcctaactcattaccataatataaaaggacctagacataagtattagagtaaatactatctgtctaggttcttttttgttatacttaaagcaataaatatcattgaaaggaagtatacgatgacaacatttactgctaaatttattgaccaagagtgggaagtcccagtagaatcaggtcgctaccatatgattgttggggaattttgtccttatgcacaacgtccgcagattgcgcgccaactgcttggtttggataaacatatttctatcagttttgtggatgatgttccaagtgatataggacttatttttagccaaccagaacaggttactggtgctaagtcgcttcgtgatatttatcatttgactgacccgacctaccaaggtccttatactatcccaattttaattgacaagaccgataatcgtattgtctgtaaggaatctgcagatttgcttcgactttttactacagatttctctgatttgcatcaagaggatgctcctgtccttttcagccaagaaactgcttcacttattgataatgacattaaagacattaataagaacttccaaagcttaatgtataagttagcttttcttgataaacaagcagattatgatacttatagtaaggaattcttcacttttctagatcaaaaagaacacttactaggacaacgtcctttcttgctcggagataatctaagtgaggttgatattcatttctttacaccattagtccgatgggatattgctgggcgtgatcttctactacttaatcagaaagcgctagaagactacccaaatattttttcttgggctaaaactttatacaatgactttaatttaaaaacattaaccaatccacaatccataaaaaataactattacttaggcaaatttggaagagctgttcgtcatcataccatcgtcccaacaggtccaaatatggcaaaatgggaaaaataaagctaaaaagctaaggcaattcacagccttagctttttagctatactagtccaaagtggaccaatcaaattcaataaaagtcttgaagagatctccataagtaccactgtaagcaatatctttatctttataagtcattttcgtaataggataattgtcaggaacagtaacacatcccattaaaactcgaataaaatcatttggattttcaaaaacttggcatcgttcagtgtcgtaagcatctttataatacagtttaatcatcttattacctctgacgttttacaaggaaactttgacaggaagctatatctacttcacaaaaataatatcatttagcattggcttccttcaattgaccatacaatatataattgacttgtcgtaaatcagttatttttttacaattcagtgcacacattatcattcttaaatcttctttccaagaattgagaattgcaataacatcatctacaggataacgctcaactaattctaaaactgttctagaaagtccaacagctttagcacccaacactaaacattttaccatatctaaaggatgacgaatgccaccagatgctaggatatccattttgtccatcatagattgagcgtttattaaggattgagctgttgtttgcccccaggtattgagatacgaacggtcgcgtccacgttgattttcgatgtaagcaaaactagtccccccacgccccgaaatatctacagttgtgatacctatatcgtaagcatcctttattgattgtaaatccatcccaaaaccaacctcttttaaaataagtgggcattggatattgtcgacgtattcttttaagtgagaacgccacatgtgaaattcacgctctccttcaggcatcaaaagttcttgcatcacattaacatgaacttgtaaaaaaatggggttcatagccttaacggttgactctgctgctggtacaggcttgtctaaccctatatttgtcgccagttttaaatcaggatacaagtctgttgttgggtaggaatcatcttcatcgtttttgagagctgccgaatatgaacctgtcaccataacaatccctgtagcttgagcaacctgtgccaatttatgattgactgctttccctttttcactaccgcctgtcatagcattgatataaaaaggaaattcaaagctttgaccagcaaaatgtgttgataaatcgatatcgttgacattatattttggtaaggatgaatgtattaactcaatatcgtcaaaactattataatgcgactgatatttaagagcatattttatgtgatcatcttttcgatttgtcatgacagtgtctccttactaagtagttcaataccagcactctcccaacgcttgattagagtttgattatcatttttattaaaggatatggctataccacaatcgcctcctccagatcctgaagattttgtgactatatctaggcctttgcttgcctctttaagcttttgaagtttatcggtgtaaatagatggatgaagattaaataatagcaagctaatttcttctaaacatctcttaatcgcttctttatctccttctttaaaggctgaaagtaactggacaacttgatactttgtatcatctaaaaaacgctgcgtaatagttgatttaactatatttatcatttcttttgaaatggacggttgcattgtccatcccactaaaaaatccatctccaataaagcttgtattttggtaatacgataaccccattcagcttccaatacttgttccaaaggttttgtttcaatcatttttgaaacagccctacgatcaaaagctgaataagaaattaaatgctcataagcaatacaagcaatatctcccattgagccattatcacctctttttaagagaacataggcagataatttaaaaagcaagtcgcttggcatctctatctcataaagcgcagccatagctttaatagtcaaaacgacaacacttccgctagagcctataccaaatttaagtccatagcgctctaattttcccgtaatttcgaggtgaatcggttttatatttttgccaaaattaatcaaccattcttccataagcaatatcgtttcctgaatgagactatattgcttatctggctgtaagcttgccgtatagttaaacatatcagaataaaggctgtagttatctgcaaaagtagctaatgcagtcatataaataggaacgttctttaaaatagctacttgcccaggatacagtatcgcgtattcacctgcaatatataatttgccacctgtttgcaccttaaccatctgctaattcctttgtcgttgaaacaataatacgataatctttctccaagatagcagctaatgcctcaaggtcttgacgtaagcaaagtactttaacatttggacccgcatccatcgtataataacattcatgacctttttcgcgaagtttcttcacaacatccatagctttatatgtctcttctgtcaaatatgaaaaggctggagttgctgttttagttgttgagtgcattgcaagtgcattacgctctgtcagttgacctaccttttgaaaatcattattttttaggtatactaacatatcttgataatcttgttcagattgccttacccattcattaaaagtagttgaagtttcggtgcagattttcataccttcacggcttgaaatcggctttcttttgtcatttaagaccagcataatcatagctaaatctaaattagtgtgaactttatagatatcaccactatctttatcccaagcagcaacaggtccaaaaaaagagcgtgaagaggagcctgaagcaaacttggcttcttgagctagctgtgattggctaaggttagtaccaaaaaaatcattgcaggcctttactaaggctgataaaccacttgatgacgatgataagcctgcagctgttggcatattattagttgtttcaatctttacaaagccggacctattttgtcgaaagcgatccaagatagctgacattttgtcatgttcatgatcattttgaagaacaccagagatgtaaaattcatctttcttagcatccttcccaagggcagtcaaacgtgtttcagtgtacatgttttcaagtgttagagaaatactactggtagctggaatcattttttcagcatctgcttttccccaatatttgataatagcaatgttagcataagacttaacacttatactttttccgtccatgtgttgacagctccttctctttctaattgctgacttaagcgctcagcttctcttttttcttttacaagtgcgataatacaaccacctaatccgccgccactcattttagcgcctagagcaccacaactaatagctacctctaccagatgatcagcttctaaacttgagacacccaattgttttaaactttgatgtgctttagtcatcaagctaccaagttgtttggaatcacttttatgaatagcatcctctgatgcctctgctaaataacctaattcttttaaaaagggtagtactgcctcgccagatgatttcaccttatccactgcttctttagtatgcccatgaattcctgtatcagcaataactaaataagcattcaaatgcatgggtactgttgaaaaaccaatattgcggataaatttaatagtattttcactaagacaagtttttgcatctaatccactcggatttgaatgtgctatcatttctgctcgattaacaaggcattctaacaaatctgcctccaaatcttcatcaaaataatcaaaaactgcacgaatagctgcaatagcaactgcagctgatgatcccataccacgtctttctgggacttgtgactcaatatgatatgcaattttagaagaagttttacctaaatagtccaaggcagcaaaaatggctgtcgacaaaggatcagtcatatctaatgctattaattgaggagcctcttcaataaggcaagttacttcaatattttttaaaggaatagcaatggctggataaccatatactactgagtgctcacccatcaagataatcttgctatgagcctttcctataccaaacttttctttcatctttttctctttacaattctattaccttactattttaatataaatccttaaaaaaagcgactttaacgtgataataacataaattaaaggaactacaattgcagtccctttaatcttaaatgtaaatgacaaaggtaatggtatcatgtttataattcacatcgatacttcctttaaatagatgcaccaaactagttacgatagaaagaccaataccatatcccgattttttgttattatgtgactcatcctctcgataaaatcgttcaaaaaacttgctatagtctatgtctttaccattcttataagtatttgaaacttcaagcttagctcgtctcaaacgacttgaacgtgataacttaactgtcacagtccccataggatcacaatacttattagcattatcaaccaataatgtaaccaattcaaataatgatttttcttcagctttgacatgaatacctggttggatactcattataaagtctttaccatctttaatgattggacctttaaaatcttctgcagcatcttttgtaatatgtgaaaagtctaagtcaaccatacttatatcaggctgttcttcaaagcgggcaagactgaccatgccattaattagacccgttaaacgttggatttgatcatttgtagatttagtccactctgattcaccactcatcatttccaccaattcattattagcggagatgatagcaagtggagtttttagttcatgtcctgcattggtaataaaacgcctttgcttttcatagttagcaacaaatggtaagataactctccctgataaaactgaaacaattaccatgaagacgataaaacttaccaaggacatccatattgaaagttgcaataatctttgattatcaagatattggttggttgtatctaaaaataccactaaataatcatttttaccaaccttttttagtagataagaataagtactaaaattataggtgatatgacctgaatgactattttgtgatacgatacgcttggcataattttttatttgcctatcgcttacttcaaagatatttctagaatcaaaactagtcacgttaccttttgcatctgttcgcgcactgaaataacggaattggaaaatagcgtccgttgataggtcatcacctaattctttactaaattcaagtttattcggtatacgtccattgttgtctgcaaggatagttaacacacgataaatttcattcttcgtttgatagtgattagcagagttgaggacaccgactactgaaaataagacaacaagaatagctagcgcagctattccgataaaacgaagtcgtaaatttctaaacattagccaccatttatttcacttaatttatagctactaccttcttgaccaataatctccaagttagcaccaattgcctgcaatttttgtctcaaataagaaacatagataaagacgtatccctcatctacatcttcttggtccttatctgctccccagacatgttcgaaaagttgttgtgtagataattctttatcatggttcaacatgaaaaatgctaacattttagcttctttacccgctagacgaatagtgttttcacattgcaactcttgttcaccgactgataaggttactcttcccaatgacaatacattaggtgtgaaatcttccaatcttcgggacatagagcgaagccttgctaataattcttttagagagaagggttttgttaaataatcatctgcaccagcatctagacctgttactctatcatcaatttctgccatggctgttagcataataatgtgagatttatttcctgattgtctaatttctttgacagcctcaatacctgttttaacaggcatcatgacatccataaccatgacatcatatgcattttgattagctaaatcaatagcagtctgaccatcgtaggcgacatcaacaacataaccttggtgactaattgccgtactaaggacacgtgacatctgttcttcatcttctgcaattaatactctcattttattccttctttgttccactctctatcaattgacgaatcgtttgcatcgttaaatcaacggatgccatttcatcagcacaacgttttaattcccttacaattcgttcgggattttcaatatcatgcttgtatttcatttgatgttctaaactagcccaagaatcttgcgcaatggtacgcaactgaatttcaatgtaatatttaccgtctgaattacccaaacagtctggatagggggtatcaatttctaaaatcacatgataagaacgatacccatttggcttaacatgctggatataatctttttcaaccacaatacgacaatcatcgaatgccttaatacgttctataatttgataaatgtcgttaacaaaaccgcaaataatacggactccaatgctatctctaatcgtttttagtgcagaatctaccgttacaggtaactgtttgcgacgacatttctctatcatactatctgacgttttaatacgaccaatgatatgttcgtacaatttatagcctgtttcaaccttagctttatcattttctaattggatacgctggctgaaatcttctaaaattaatggtagatatcgaccataatctccataaatatttgtttccataagaaaccttcctattctctcttagcctccattatatcatagaaacttaaggcaaactaaaaagatggtaggtactgtgagactatttatacaaataattgttacttaaggatcttaccacaataatttgtaaaatttattgagtttgtcaagcaaaggcagttataaagttaagataattagtaattattttttcaaattctttttgtgattgataatctaaaacgacatgagaactactagaattatgatctgtttcaatgtatataaaaatttcaaattgagactgctcaataaatatggtatcggcatcattgataaactttctttttaatgtcttataataaaattccataaaatatatcctatgaatttccttttagtttcacactagcaaggggtttctctcctaaatatatctcggaatcatatttcagtatattaagagtctttaacggtataggctattaacctttctttgaaattttcttgatgataagtctaattgaaattatccattaccaacttgtcctgtattcgatttccatcccctagccaacaatcttttagttataaacttctaataacacctaataaataaagagtacttacttttatcgaaatatagaacaagactctctttgctaggttttatttttatatattttgaagatagtctgtactttatataggtataaaaaccgggataggaaatttggtgcatttaacataggtatattcagtttagcattatcttccttttaattagagcgttaagccctctaataatattttattccctttttaaaatgataaattgcaaaaaaagccatcaaatgatgactttttatgtagactcgcaagacgctcctctttagatatagctataattaactcattacaatccaaacacaccataacaaatagttcatcaaaatctatgatgtgattattaacaaaagaatcttataataacggtattggatcacatcgagtcagaagaattttaatttttacgtcgttttaaactgctagctgccaaagtagctgttgttgctactagagtaatcccaacaactccgagagttctattactttcctcgcctgtagttggaagaacagatttattggttggttttttagatgaagttaatactcctttgttaggtctattttctgtagtttgggtagatataaacttaggagactctgattcgcttggaatagaaattcccatttcctttggtagggtagattttactgattctcgatacacataagtcacttctgttgtgccttcagtgacctttccgaattcatttcccatagtttttgcagaaacgagtttataaatcttaccattaaatttaatttcagcgaatttataatctgtggtatcatatggtgtcccaacctttgattcgtgtgtatctagtattggttttttgataacattacctgtttcgtccacatagttaatcactacattccctacagcctctgattcatctttcttaagcttatattcatatgtaatggtctgatcttgttcagtcaccttaccatctgctggagcatcgcccttattatcacgcacatgtacaaattcatacaacttaccatctttttcaagagttgcaggtgctctatctgaatatgcttcatcaattggagcttctgatttaactgttttaacacttgcaagctcagtctctgtccctaaaataacatagcgggcatgaacatttccaactttaacgcttggaacctctaccactttacgatattgatagacaacatgttgttccccttctcgaagtgttcctttctccgctgctgatccctcttgaattgaaactagttcatattttattccatctttgtcaagtaacaatggtttctcagaatcattctcagctgtattataaggagtagcttggccttctttatcacgaatataagctgttggggtatcgacataggtatctttaagttttgtagcagtaccctcgataacataatctacaaccacacgacccttaggaacttcaacatattcatatgtaatggtctgatcttgttcagtcaccttaccatctgctggagcatcgcccttattatcacgcacatgtacaaattcatacaacttaccatctttttcaagagttgcaggtgctctatctgaatatgcttcatcaattggagcttctgatttaactgttttaacacttgcaagctcagtctctgtccctaaaataacatagcgggcatgaacattgccctttgattcttgtttaatgctataaacataagttactgacttagtaccttctgcaacttctccagatgctgcatcagtaccataattaaatgagcctccatttgtagccaacgtaccatccgaattaaccttaccaactggtactgtaatattttctgctactaattcatacaccttaccatctttagtaatagtgaaaggacgctcaactgtcgcgtctgaactaaggtctcctgatgattctgccgtattgtaatgtgttcctagaattgcatcggtggtatctttgtattcagtaccaataatattgccttctgtatcaatataatttacaacaactgatccacgcggattttgtaagcgaacagataaacgaagtaagtcatcgttcgaaatatcattattatcggaaattttatcatcaataacatcgcttgcgtgcttatttaaaccattaatactatctggtttaactacagttggtcgaatattcgcagtactattataatatccatctcctgtatgatatttctctttagaaaatgctgtaaatggaacagcttgatgatataatttaaatgaaacctctgtaaaggttccttttaaacgaattgaacctgttcccgctgggactgcatcaggcgttctatctagaccattgacaaagtctgcgtcagatggattaacaactgactcattaaaggtgtttttgtctgttacatcaaccgtattcgctgtaactgttaaattaactcctgaacttgctttttcaaggcttatacctggagttattaactcaaagaacgttgaattatatgaaccacgtgcatagtcaattttttcaacaatcctaccattttcattggtagtttctgtaaatgatagatgtgcattacctccaacaccagataagtcaataatagggtctgtaactgccttgtcaaatttcaatgttaaaatagttgatggcgccttcccattaaaattgagcttatcagatagtttactacctccttcagtacgtcctggttgtgtatagacacctaaagcaggtatttttgcaggatctacatttccaacaaacatttctgatgttgctttatattctgactgattaccaccatttgttaaaacaccagaaccttcatcattccctggtacaggagtaattgtcgcagtcactttgacggttgagttatcgtcacgaaccaccgttgtttcagcacttttaaatgattcatcacgaacacttggagaaatatttttatttcgaacactgtcagcatatggattttgtaacgtccaatcgccactagtagcatacgtcctcttgtctactgatggggctacattatcagttgttggtgatgttgctgctaaagttgcaggcttaatgatttctgaagtattactcaaattacttccttgagtgctagttgcactcctattagtggaagtaggagttgaattgttagaagtgaccaagtttgcatctgtggccgttacacctgttggagttgttgcagatgtaacactagttgtctcatctgcaagtacctgaggagaaatgaataataatgatcctatagcaactgaagctactccaaccgaaaatttacgaatggaaaactttaaacctttttcaaaattatatttacgaaacataatatcaacctccctgtaacagtttttatatttcacataatgaatagcaaaaaattaaaacgctgtcaattagaaaggtaaagatttttgaaaattaccctaatttaaaaatattttgactttacataaaactaaagaggagtcttattcaagataaattgaaaaatagatactaagacctggtagtttacataaaacagattcgatacttctatccaatataaagataattaaggagacttttaactaaaaagtgtctctgaaagctatttacaattgattatattatcacaagtctattaagcaggtttaaaatcatattatcagacactataaaaactatctggtgtagctgattgtattaaaatatttagtatatctatttaccttgctcattgtccaaatgggaggttcatctcaaagtattacagtataacaagttaaactgtagcttaaaaatttcctaaaatttctttacaatatcatcctcatcaatcatgttgctctttaacactaaaactacttaaacacaggaatttccaaaagaacaaaacagttaaagtgactaatcgtttagttcttttagattgaagttgaaatggtaaacgagaactatcggctatatttaaaaatgattctctagataacttacctttattaaatattgttaaactagcaatcctgtagaagtaattcttaccaattctctcttcatgtctttaataaaatcacagcattaagtcatcaccctaagatagttaatcaagattttccattgccatatttttagctaatgtcctaataacctttttggtggtacgaatctcttctttagtaatacctgctaacatagtactatgcaatttttctaagaaaatttcaaattgtgtagccttttttttacctaagtgagtcaaataaagatattttacacgcttatctgtcttagatggtacaatcgcaataaaaccatttttttccatccgttttaccaaattagaagctacagacttagaaatgtgtaagatttcttcaacagcttttatagacatatccttatcaggatgtttatagagatacatcactaggtgtccttgtggacccgctaaatgttcaacatcatattcttttgcataatgatctaaatacttttcaagttgattaacaagtattcgtgctttttgaagaggattctccataatcatactcctttaatagttaccgtgagaactattttaaaacaacctttattaattgtcaattaaaacttatcgtaagaactactcctacattaaaatttctaatatatatatatatatcattcgttaaataaaaaattatttcgcttactatccaagattaaaaatatatgttcgtttttttatatcttaaattataaatttatattgatttttaatttaaatgttagtaaaatacaaatgtaatatttatttaatttacaggagatttaaatgaaaaagaaaattattttgaaaagtagtgttcttggtttagtcgctgggacttctattatgttctcaagcgtgttcgcggaccaagtcggtgtccaagttataggcgtcaatgactttcatggtgcacttgacaatactggaacagcaaatatgcctgatggaaaagttgctaatgctggtactgctgctcaattagatgcttatatggatgacgctcaaaaagatttcaaacaaactaaccctaatggtgaaagcattagggttcaagcaggcgatatggttggagcaagtccagccaactctgggcttcttcaagatgaaccaactgtcaaaaattttaatgcaatgaatgttgagtatggcacattgggtaaccatgaatttgatgaagggttggcagaatataatcgtatcgttactggtaaagcccctgctccagattctaatattaataatattacgaaatcatacccacatgaagctgcaaaacaagaaattgtagtggcaaatgttattgataaagttaacaaacaaattccttacaattggaagccttacgctattaaaaatattcctgtaaataacaaaagtgtgaacgttggctttatcgggattgtcaccaaagacatcccaaaccttgtcttacgtaaaaattatgaacaatatgaatttttagatgaagctgaaacaatcgttaaatacgccaaagaattacaagctaaaaatgtcaaagctattgtagttctcgcacatgtacctgcaacaagtaaaaatgatattgctgaaggtgaagcagcagaaatgatgaaaaaagtcaatcaactcttccctgaaaatagcgtagatattgtctttgctggacacaatcatcaatatacaaatggtcttgttggtaaaactcgtattgtacaagcgctctctcaaggaaaagcctatgctgatgtacgtggtgtcttagatactgatacacaagatttcattgagaccccttcagctaaagtaattgcagttgctcctggtaaaaaaacaggtagtgccgatattcaagccattgttgaccaagctaatactatcgttaaacaagtaacagaagctaaaattggtactgccgaggtaagtgtcatgattacgcgttctgttgatcaagataatgttagtccggtaggcagcctcatcacagaggctcaactagcaattgctcgaaaaagctggccagatatcgattttgccatgacaaataatggtggcattcgtgctgacttactcatcaaaccagatggaacaatcacctggggagctgcacaagcagttcaaccttttggtaatatcttacaagtcgtcgaaattactggtagagatctttataaagcactcaacgaacaatacgaccaaaaacaaaatttcttccttcaaatagctggtctgcgatacacttacacagataataaagagggcggggaagaaacaccatttaaagttgtaaaagcttataaatcaaatggtgaggaaatcaatcctgatgcaaaatacaaattagttatcaatgactttttattcggtggtggtgatggctttgcaagcttcagaaatgccaaacttctaggagccattaaccccgatacagaggtatttatggcctatatcactgatttagaaaaagctggtaaaaaagtgagcgttccaaataataaacctaaaatctatgtcactatgaagatggttaatgaaactattacacaaaatgatggtacacatagcattattaagaaactttatttagatcgacaaggaaatattgtagcacaagagattgtatcagacactttaaaccaaacaaaatcaaaatctacaaaaatcaaccctgtaactacaattcacaaaaaacaattacaccaatttacagctattaaccctatgagaaattatggcaaaccatcaaactccactactgtaaaatcaaaacaattaccaaaaacaaactctgaatatggacaatcattccttatgtctgtctttggtgttggacttataggaattgctttaaatacaaagaaaaaacatatgaaataataaaaataggtttggataaaatatccaaacctatttttatattaatatgccttccaaatgatctaactcgtgttgacaaatttgagctggaaaatctgtcaacttgatttgctgttccttccaattgatatcacgataagaaatcgtaatgtgacaatatcgttgtgtacttctgcaacctacgagagaaaggcaagattcttctgtctcatatggatccgattttgcaactactacagggttaaacattactaaatttgtaatacccacattgatgataatgacacgcttcagactaccaatcatatttgctgccatacctacacaataattttgattagcatgcaaagtctcctgtaaatcttttgctaagctcacatctgctctactagccatttgtgatttttgttgtaaaaagaaagtatctctaacaattggttttatcatttattttaacctaactctattatgataatactagtataccataggttagctaaggactatgataagagattaaacaataccttgtgcagacatagcttgagcaacttttaaaaagcctgcaatgttagcacctagaaccaggttaccactatcgccaaattcatcagccgcttcggaagcattcacaaaaatagttttcataatacgttgcaattcttgatcaacttcttcaaaagtccatgccctacgactagaattttgtgccatttcaagcgctgaaacagctactccccctgcattggcagctttagcaggaccaaaagcaacccctgccttttggaaaactttaatagcacccaaggtagatggcatatttgctccttctgttactgccaagacaccattttcaactaataacttagcgtcttcttcgtctaattcgttttgagtagcacacgggaaagctaaatcagctttaatagaccagatactaccttgatctgctggtgtgaaattagcttttggatgtttctccgtatatttaacaatacgtgctctttcaacctcttttatctgtttcaatgtttcaaggtcaataccgtctggatcataaacataacctgaagaatctgatacagctacaacagttgcacccaactcttgtaatttttcagtagcataaatagccacgttaccagatcccgaaaccagtgcaactttgccagttaaatcttgaccacgcgctgctagcatttctttagcaaaatagactgccccataaccagttgcttctgtacgagccaaagagccaccataagtcagtccttttccggttaaaaccccattttgataaccatttaaacgcttatattgaccataaagataaccaatttcacgtccacctactccaatatcgccagctggcacatctaaatctggtccaatgtatttttgaagttcagtcataaaactttgtgtgaaacgcatcacttcattatctgatttcccttttggatcaaagtttgaccctcctttgccaccaccaattggtagacctgtcagtgaattcttaaaaatttgttcaaatcctaaaaatttgacaatagattgtgttactgtagggtgaaaacgtaaaccacctttataaggaccaatagctgatgaaaattgtacacgatatcctcggttaacttgaacctggcctttatcatctacccatggaactctaaaagaaatcacgcgctcaggctcaaccaaacgttctaaaagattttcttcaatgtactgagggtatttatcaaaaactggtactagtgactcaaaaacctcttcaaccgcttgtagaaattcttcctcatgctcattttgcttcttcactttctctaaaacacttgctacatatgtctttccgcttgtcatttattttcctccgtattgttttaatatagttagcattataaattgtcagaattttcttgtcaactatttgctatggtatcattattaggagcaattttaaaggtaattatttgacttttactgactttcgttctataatgagacaaatatttgattggagtatctatatgaaatggttcccacttgttggaggtataattgccttattagctggcttctatctctttataaatcctgtaacggttgttgcaactctgggttggttcattgctttatttatctttatttatggcatttcaaatttagtacgctacttgcaagctgattcttatcaccgtagcccttggtatctggttcagagtatccttgctattatttttggtatcattttactatccagctcagcaatgtcactttcaaatactgtcatgactattttagcatactggctactggtatctggtattttacgacttttgggtggtttccaaatgcaaaaaattaatttcccaggtgccaaatcctataaacgttcggcttatattgcactcattttaggtattattttactggttcaacctaccttatcagcagccatcattggaagatttgtagcctttatattaatagcaattggagcttcggctatttacacttttactcgtattaattattaaaaggacatgtttcgtgtcctttttttatctattgatgacgtcatttactatttgaaaattggctattatataattcgtaataaaatcctttatctgctaggagtttctggtgattaccttgttcgatgatttgaccatcctttagaactaaaatgttgtctgcctcttgaatcgttgatagacggtgtgcaatgacaaaactagttcttccttccatcaattttttcatagctttttgaataagcaattccaaccttgtatcaacagatgaagtcgcttcatctaaaattaaaattttaggatctgctaataaagcacgtgcaatagtcaacagttgcttttgtcctaaggagatattgcttgattcttgattcatcaccatattgtagccaccaggtaacgttcgaataaagtggtcaacattcgcagctttggcagcagcaactatatcctcatcactggcttcaagattaccgaatctaagattttcttttattgtaccttcatataaccaagcatcttgcaacaccatgccaaattgttgccggaaatcttggcgtgataggtgtctaatatcgtgaccatctacggtgatagcaccttcactaacatcgtagaatctcatgagtaagtttataagtgttgtcttacctgcacctgttggccctacaattgcaatcatttgccctggttctacatctaagttaaagtcgcggataagtggcttatccggagaatagtgaaaatcgacaccatgaaagctgacttgaccggttaagtcatggctcaatttttcagtgacttgattggcttcctcttcttcatctaagacttcaaaaatacgttctaaggaagattttgcactttgcaaaacacctgctaattgtgtaatggtttgaacgggttgactaatttgccaaacatactgcacaaatgcctgcatgttaccaattgttaaggtaccagcaataacttgtaaaccgccaacaaatgcaatgataagataaataaaatcagagatactattcaatactggcatcataattcctgaaatgaagctagctttgaaacctacatgacgtagattatccgttatatcacgaaattcttgactagacgcctcttctctaccatataattttatgatattgaaaccagttaatttctcttgtacaaaaccattcagttctcccagaatctttgcctgttctttaaagtaaggttgggatctttttagtatcgcttgtgcactaaaataagttacaggaatacaagcaatgataatcatggctaatggtacatttagataaagtaccataacgactactagaataatacttaaaaaagcattgataatctgtaaaaagctctgttgtaaagcatttgagaccgtttcaacatcacttgtaaaacgtcccaacatatctccaaattggtgcttatcaaaatacgatacaggaactttattgattttacgattcaaatcatgacggatatcacggatacttttttgaacgacagtagtcataaaataatttgagccataagaacctaattcatagaaaacacctctgaaaaaataaataatcagaataccagcaatataaggaacgttcaattctgccccagaaactcccttagccatatcaacaaggttagcagtcaactctgttatcgctaaccctaaaataaaaggctccagaatactcataaaactagataaaactttcaaaaaaatcgctaagaaaagagtagctttgtagcgagttaggtaagaccataatctcaaaaaaatagatttttttctcatacaatcactctccttctgataagttttggttcttcagttgtgactcagcgatttcacgataaatagcattattttctattaattgagcgtgggtaccacgaccgacaatttcgccttcatcaaggacaataatctgatcagcatccataatcgtacccaccctttgagcaactatcaaaaccgtagaatcaccggttacttcttttagacgcgctcttaaagtagcgtctgtcttataatcgagagcagaaaatgaatcatcaaaaatatataaatctggatctttaacaacagccctagcaatggataaccgttgtttttgacccccagaaagattgctcccaccttcagctaaatgcgtttcaaaggcttcttggtgactctcaataaactctttagcttgagaaatatcaaccgcttgtctaagatcatcaatagtagcatcagcttttccatattttaaattctctcctattgtccctgtaaataaaagagctttttgggggataaatccaatcttttggcgaagtgatttaaggttataatctcttacatcaactccatctactaagatttttccaagtgtcacatcataaaaacgtggaatcaaattaacaagagaagattttcctgaacctgttgaaccaataaaagcaattgtttctccaggcttagctttaaaagaaatatcatgcaaaacgggactctctgtttctcctggataagcgaatgttacattatcaaattctaaatgccctttaagtttcgtatccgtaacaccttcggtattaggattaatagaaatcggcatatccattacctctctaatacgatggctagataccaccatacgaggatacatagtaaaaagattggcaaatagcaaaaatgaaaagagagcatggaagctatattcgataaaagcaactaaatcccctattttaatagcacctctttgtaagggatccaaagcaaaccaaacgatagccacaatcattgcaataataatttgaacgaaaagtggttctgttagccctgttaatttaaaaagaccagttgaagtatctgtgtaacgttggttagcgacttgaaatttttgtgattgaaaattctctcttgcaaaggccctaacaacgcgtaaccctgttaaattttcacgaacatattgattgattttatcaagcatagtctgttgtctttcagataaaggttttgtttttatagctacatataaaataactcctaccaaaagaggcatcgcaaccgctacaagccaagctaaagatggactcgtaattagtatcataaccacgctaaaaatcattaccataggagttactaggcctaaacgtaaagacatttcagcaaattgcatcaaaacaaaagtatcgcttgtcatacgtgtcactagtgaagatacacctatctgttcatattcatgatgggagtattcttgaagcttagcatacatatcattacgcatatctctaatcattgttgtcgttaagcgactagatgcgtaagccatcgtaatacgcccaataatacctagtacaacaaatataaacatgatgaacgtccacagataaactccagtccgatcaccttttgtaacgccattatcaatcatacccgctaaggctgtgggcattcctaggataaccgtcacaaaaagcatagctcctagtaaatcaagccataaccaattggggtaccttttcaaataagaccaaatatatgccatatatgtctccttttctttcctcttatctcaaaataattaatccatgttcactaatccactttcaacttataaatctttaatcatccaaatatccatagctgtatgaccttgatcatttgctattggttgcgataaggcacaatatcccatatgcttataaaccgcagttgccctactcaaagtactggctgtctctaaataaagttgtctatacccaatttttcgagcttctacttcaatcattttcactaaatcagtagcaagccccttaccacggaaacgttctgcaatgtacaccttctgcatctctgcaattagatttttcagcggaccaaagccgccacagccaataatctcatctctctcctcaatgacaaagaatcctgacttctctattttttcgtagtatgaggtcaaatgatctaagtgagggtctgaatatgctgtatcaggtttatctaaatcataggcgcgtaaactttgtcgaattaattgtgcaactgcttggtcatcatttttaataatcggacggataatcatgtgtctaactcactaaggtactcataacggtcatacttttctagaagtgcttcattttttgcatctaattccttttgtaaatcagataaccttgtaaaatcactaccacatgtttgcatatcattttctatacgagtgatagtattttccaatatcataatatcgtcttcaattgtcgcccattcttgtttttcaaagtaagacattcttttacgactttgcttttcacgacttgtcttggtactctcttttttactgataacttcattattttgctcattaaatgctttttcatctaaataatcagtataattaccaaaaaattcacggatatcgttatcttcaaacgcaataattttattagccactttatctaaaaagtaacgatcgtgactaactgtaatcacaggaccaccaaagccttgtaaaaaattttcaagaacagttaatgtagcaatatctaagtcatttgtcggctcatcaagtagtaacacattaggcttttcaatcaggatttttaaaaggtaaagtctttttttctcaccacctgataattttgcaatttgtgttccatgtgtcgaacgtggaaagagaaattgttccaatagttctgtcacacttgttgtaccgacactagttttaacctcatctgcaacctcttgcaaataattaataacacgttttgagccatccatattatgaagttgttgtgaaaagtaacctacacgtatcgtttcaccaatagagacattacccgaatccggctgtaaatcttgaacaattaaattaagtaaggttgactttccaacaccattatctccaacgatgccaatacggtctttattttgaattaacaaattaaagtctttcaagatagatttatctgggtaagaaaaagagacattttcaaaattaataacctttttcccaattcgacttgtttcaaatgtcatttccaaatcgcttgtatcgcttgtttggtgtaaatcgttttttagattttgaaaacgattaatacgagcctgttgtttcgttgcacgagcttgtggctgagtacgcatccaagctagttcctgtttataaagctgtttctttttatgtaaactagcagcatcacgctcgtcttgttctgcacgaagtcggacataatcctgataattgccttgatattctgtaatctgtgccttatctaattcaaaaatacgtgttgcaacattgtctagaaaataacgatcatgagttataaaaagcactgtctttttactatttttcaaaaaattcgttaaccatgcaatagtgtcaatatctaagtggttagtaggttcgtctaagagcaataaatctgcatcatttaataatacttgcgctaattgaacacgtcttcgtaatcctcctgataattcaccaaccgacaactgcaaatcagtaatacctaatttggataatactgttttgacttcgctctcaatagaccaagcatctaaagaatccatttctgccattactttctctagacgtgattgcttactttcttcgtagtgattaagcaataattcatattctttaattaaagccatctctcttaagtcagaagaaagtacggtgtccaaaattgtctgagaatcatcaaagtctggttcttgttttaaataagcaatcttataatcattagctgatgaaaaaggggaacgatcaccatcaaaacctaattcacccgaaataacatctaatagtgttgtctttccagttccattgacaccaataatcccaatacggtctaaactatggatgataaatgaaacattactaaagaccgtcttatcaccaaccgacttagtcaatccatctactaaaaaatcgctcatataatcctctctaatccatcaagtactgcttaacaaaatgtaaaatagcctcttcttcattaatcagttgtcctaaaacaatggctaattcaatttgagagataatatctcccatctgtggaccaggttttattcctaatttcttgattaaggtgccaccattgacaactatctcatgcctatcatggattgctaactcactatctagttgttctattttttcgaaatcaaccatcaagcctcttgctttgcgaataccttccgcttgttttattatagtttttccataacgataaagatgttctttagtcaatcccatttgttcacgaatacgataaacatccactatatgctcaacatctttttgaaagtgagttgatgtcttccatttttttaaaaaagtctttgtgtgttcaacttccatactcaagatgagtgatgcccaagcttgttctgatgtctcaaataaaaaatctttatctaactgggacaaaaaggcgcttaattgtaattccctattttttaagcatggtagataattaaaagcatgactatctattagtgccagcattcctttacgccaataaggtgctaatagaagtttatcaaattcaataaaagaacgctcaacagatattttctccaataatgacgcgtgctttttcattgcctcaaaagttgttgtttcgatatcaaaatttagactagcagaaaaacgcaaaccacgcataattcgaagagcatcttcattaaaacgctcactggcgagtcctactgctctaagaaggtgattatctaaatcatccaatccatgaaagagatcaataacttctccatcttcatttaaagcaaaggcattaactgtgaaatctcgacgttttagatcttcttctagcgacctaacaaaattgacctgactcggacgcctataatcaacataaacctcctcagtcctaaaagtggtaatctcatattcaccacctttttccaatactaagactgttccatgttcaataccaacatcaactgtccttttaaaaatctgctttgtttcttctggataagatgacgttgctatatcaacatcatgaattggacggtcaagtaaaacatcccgaacactaccacctacaaagtatgcttcataaccggctttttttatcttttttaatattggtaaagccttctgaaactcagaaggcaaataatttaatctcatcatactattccaaatctaaacgaactaaagtcgcattattatttcttataaatggattcagaaacaaaaagaactgcctaagggacactccctacctactcaaattatcaaaaaagaatctcctaacttcttctttgatatctgcaataaggatcaacctccaagcaactctttttatcacacatcaatttttgggggtaataccaaaggcaaccgcaccttcaccaagatgagttgcaataacgccaccaaatgatacaatttctaaatcgtctttaagaccagctttagctaacaaattatataattgttctgccttatcttgtgctctagagtgaataatagcaatatcatattcaccatctgctgtcatttctttgacaatctcagccaagcgttttaaggcttttttctctgtacgcactttctcatagacaacgattttaccttcttcattaaaatgtaagaccggcttgatacttaaaaggttaccaatgatagctgaaccgtttgacaatctaccaccttttactagatgattcaaatcattaacaacaataaatccttcaattttttcaatttgtgattgtatcttgttaactatgacatcaaaatccatcccttcacgtgaacacatcaaagcatttctaactaaattgccctgtggtgctgaagttattttagtatccggaaaagcaattgtcaaatttggatgttcttcaataagaaactgaatattctgccagaaacctgatatccccgctgcaatgaataaaccaaggacgtgtgtatacccttctttctccaattgacataagagatcatctagttcagctaagctaggctgacttgttttaggtaattcttttgatgccgctagcttatcataatattggtctaatgtcagattttgtccctcaatataagttttaccatcaatgataattggaatatctaaaacatagacatcttcatgattttcgatagcctcaggcaagtaagctgaggtatccgtaataagtgctaatttcattaactattaaactccaatgttactcctggtctatctaaagcaatttctgtaacttcataagtcagacgtttaacgatttctaaaagaggagctgctagattctcaacttcatcttgactaaactcactaggctcattgataaggcgcccttggatatgagccatttgtgaaatgacaccagaaataacaaactcatcacgtacaataacaaattgtaacactgctacaatgctcgttacttttgctgcttcatctctattagctaattggaaagtaacttcaaaatttgtttttggggtaccattttcctcttcccattctaaattgcgcgcatcatagtggtattgattgacaaattcttgttcacgaatgacttccatgtattttctccttgatagacaatatgtattattatagcataaatttgtagattcttaaagcaggtgggaatctagaacttcttcttaggatgtctatcaatcacttcttgattgttactcaaggctgctaaacctttttctgtaagtgccaaccctctgacaacaaacaacttccctaattcctcttctgtaaaagcaatagctattgcctgatctaaatcagagcgtttcatctttgacaagccttttacgtttttttcttttaagaatagttttaaaagtggagcagataagtgatctaaagaatcaagcggtgactccattcttacaaatccattttttattaaaaattctaggtgttcttttccatttataccataaatgtattcaaaatattttgaaaaacttgtttcagttgtgaaagttccaaactgtatacgccataataagataatatctccaggcaagagtccttcactagtttcttccatatttttcctaggaacaactttactaaaattaatttcagccaagtctctttcaggtgagatataggggatattaggataatttttgtaaatttcttcaatagttttcatagtcatattgtagcaaaaaagcgcttataaaaacaagcgctaaggcatgggggaagtcacctttttgaaaaattcaatttcattttctgatattctaaccatgttaaaattatcatgataacatcaaatacacatagaaaaatcattaaaatgctatgactagaaaaatattcccttagttggaaaatgataaacccaacgaaaactaaaattgataaagggtaagcaaataatttctctttatgtaataaaataagtgctactaatttgataccgccatgaattaatagatagatagcggctaaatgactagccgaatcattaatataactgcttattttcaagaaatgagcagaaataaaaccatgaatcccaccgtgaacttcaccttcagttaaaagaaataggagatgttttatttgtgtaggtttaaaataatataataaaacgccagctactacttgtccgactgcaaatagcgtttttagatacaacataattgaaaaacttgtatcaactagttttgtttctttttcattccatttaatcattgcttacctcctttcctcaatcatattatccatttttttgcttaaataaatcatatcctattgaaaaaagattagcaattattaatgattaatctaccattcttttacaacataaaaaggcgaatagacccaataacgatagtttattcaccttttattcaatgtaaatttggataagttgagattaactattttattttacggaacaagccaaagagtacacctgagactaccgctccaattagaataaatagaatataaagtaaaggattacttgttaatgcgatgacaaaaatccctccatgaggagccatcaacttgataccagctaaaccaacaagtgctccagttaaggctgaacctacaataaagctagggattgcacgagctgggtcagcagcaccaaacggaatagcaccttcagtgataaaagataaccccataacgatatttgttagaccagattgacgttcttcattattaaatttatctttaaataataaagttgccacaaatactgctaacggtggaaccattcctccagccattacagctgccataacaacagagccgccatttgcaacagttgctgcaagagtacctgtaccaaaaacataagctgctttattaacaggcccacccatatctacagccatcataccaccaactagtaagcccatcaagactgctgaactaccagataaaccttgtaagaaagtgttaagagctgtgttgatagctgccattggaatgtttacgagcaacatcaagaaacctgtaatcaaaacacctaacaatgggtatagaagaattgatttaataccttcaagcgattttgggagacctgaaagtaattttctaagtagtaggataactccaccagctaagaaaccacctactaaagcccctaagaaacctgatggcacacctgctaatgctaaggttgctttcccaccttctgcaaaaggtactttaccgaatgccagtccacttgatgcaattgaaccagctacgaagccagctactagtcctggtttttcagctattgaataagcgatataacctgccaatactggtaacataaatgcaaatgctgcgccaccgatatttttgaataaggctgcaatttcatggtatgaacctaaattacttaattggtcttttggtacaccaagtatgttatcaaaaaggaaagcaatcgcaatcataataccaccaccaataacgaatggtaacatttgtgatacaccacccataaggtgtttataaaaagcagagcctaagcctgattttccatcagattcacctgattgtttatcattttgattttttgcatgataggtttgtgccttattatcgagaataatgttaattaagtcttcactttttttaataccatcagctaccggacgtgataccaaaggtttgccatcaaaacgatccatctctacagccttatctgctgcaataataacacccttagcccttgcaatatcacttgaagtcaacttatttcctacaccagaagcgccatttgtttcaactttaatacctacacccatttcagctgcttttttctttaaagcttcttctgccatatacgtgtgggcaattcccgtagtgcaagctgttactgcaacaatataatctgaacctttacttgttgattgtactgtttgtggagctactgtttcttgagaaatgctattactatcaaaagtagcaataatgtcatctggcgtttttgcttgacgtaattgatcagcgaacccttcttttaaaagatatttagatagttctgccaaggcagctaaatgcgtatcattagcaccatctggcgcagcaatcataaagaataaatcagttggctgtccatcaagtgcttcgtaatcaacacctgatgcagattttgcaaaaaggacagtagcttctttaacggcagcatttttactatgtggcatagcgataccatcacctaatccagttgatgtttgtgcctcacgcttcatgataccatctttaaaaatagcaaagtttgtcacaacacctgtgtcaactaattttgtaatcatttcatcaattgcagcctctttactggttgcttttaaatccataatcataacttctttttttagtaggtcttggattttcataatttttctacctcaactttattataaatatcttggataaactcagctgttgctaaatcatctgagaaagtggttgctgtaccacaagctacgccccattttagtgcttctactggattttttgacttaacaaattctcctgtaaagccagctaccattgaatcaccagccccaacggaatttttcacttcacccttaatcggttttgcaaaatatgaagcttctggagttactaacaatgcaccatcccctgccatagaaacgataacattcttagctcctttatctagaatcttatgtgcatatttttcgatatcaggcagaccttctagctctacgccaaaaatatctgctaattcatggttattcggttttactaaaagaggctgataagcaagagcgtctaaaagtgtctgaccttcaaaatcgcaaacaacttccgctcctgtctttttagcaattggaatcaatgtattatagaccttatttccaaggctagctggtgctgaacctgcgaaaactactgtgtcctcaggtgttagtctcgaaagaagtttctctagacgatgaagttgttcatttgttatcctaggacccccgccattgatttcagtttcaatttttgcttttactttaacgttgatacgtgtatcttcattaacagaaacaaagtcagttttgataccttctaatacaagtccatcttcaacaaaatgtcctgtaaatccaccgataaaacctgtagcagtattgtcaatttttaagcgttttaatatgcgactaacattaattcctttaccacctacatatttatcatcgctagtcatacggttaacactacccaacaatagtgtatctagacgaacaataaaatcaatcgatggatttaatgttactgtataaatcatacttgaatcaccttcattttctcttttattattgtcataagttctgaatcagtcttattagttactaaattaatgtcatttatctctttcactttagcaaatgtaacttgtccaattttagatgaatccattagaataaaggtttgttgactattattaataatagcttctttaatagcagcttcttctaaatctggtgtagttaaataaacttcatctataccattcatccccagaaaagctttgtcaaccgttatctgcctaatctgattaatggctacctggccaatactagcatctgttgaatgtttaaccgctcctccgataatgattgtttttatccctctatcaactaactttgcagcatgatgaatagaattcgtcaccaccgttaattgctcgtgagggagaaaatcaattaataattctgtcgtagttccggcatcaataaatataacatcttgctttgctatcagctttgcagtttgtctagcaatatccaattttttttgaacgtttttgatagctttttcttgattacttaattcctggccaagtgagtatggtaattcagcaccaccatgcaccctttttaaaaaacctgcagattcaagttcatctaaatccctgcgaactgtagattcagaagtctctaagatagacgttaattcatctaaagtaacactcttattttgctcaagtcgtgataagataatttcttttctctttgactttagcatagtccctccttgaattgaaatcgtttgcaatttaattatatctctttttctttcaatgtcaagcattttcttccaaaaactatcaataaactaaaaaagcctaatctaaagattagcttttacaaatactttaatttctcttcaaaacctttttaagaagctgaattcctttgtatttaaaaggacttggataatagttaaaagttcccattttacgaatgatacaaccattaaaattctgtttaaagcgaagaatactatctgaaccatcaaaagttccctgaatacctaggaggttatagaaagtagaacctcttttgagagcctcttgcataacatattcctgaagaactgctggtgcataaaatttattaaattctgtgtaggatcctgaaaagaaataaactgtctccttaagactataaacaaatagactaccagctaaaacaacgtcttggttatcatacttttgaataaatgactgaacttcttgtcgtcgtgtttcaaaactagccagttgattaattatttcagagcgttgcctatgatacttaggagagtctgcattttccctaaaacgttcatcaagcaatttaagcttattttccaatgcttcagcttttatttgcaagttatggtcgtattctctaaaatttaaagtggcaatcacaaattcagccttgccttcaaagctatcgtaaaaatcttgataataatctaaggacttatccatataatcacgtctatttgacgtagaagttgttatctctttaaataaatgtagctcatcacgtttaagaacgcgaaccttgattccaaaagacattgctttcttaaccaaagctcgtcctgtcttagagaatgaagatagtaacgtttcagaagtgacaccttctaaatttttaacatagtgccaagataaatatttaccagtaaaaccagttgttaaaccatcatggtgataacctgaactggtaaaatcttcaatcagattatcatttccctgattactaggaactcccgaactagtgaataattggtaatcatcataaggctcaactattaattctagaacaccgttggatttggcatagccttgcaatgctttataaaattgttttagatacttagaatttgaatgaactggtcctgaatcaattttcatttgaaaaccaccagtgactggcataatataagataaactgattatctctagtttattttctacttgatatcccaaatacctaacatcatagccgcgtttttctaaaagtttagccatctcaggtgtttgtaaaaatgattgtgaatcataatttcctgaatgttctttaaattcttctattgttaattctcgaagcgtcataaatacctttcttaactatttcctacttttctccacattctatctattcgatactatccaaataatataattttgacgtaaatctccactgttttttccaacacacataatattagtaaagctaaatctaaaaagatttagctttaaatttcaatatagcgacgaataccggaataactcttgtatgaaatccactgatgaccatctactactaacacttgatcataatgtattttttcacccttttgaaaattaaattccactggacttgatactttaggttgacttttcacatctacagttttagtaaatgtataggtacctgttttaggtaagttgggataactagtcggtttagtcgcctcatctttcgctttttcactacttgtagttagctttttcacaggaatatagcgacgaacaccactataagatttgtaagaaatccactggtaaccatctgctgtcaatacttgatcataatttattttgtcacctttttctaaagtaaattgggtctgacttgatattttagcttcattttttacttcagtacttccgataatattataaacaccagtctttgctaaaccattttcaataggttcttgagaagaattagttccagctactgtcactttagttcctgttacacctacaagtgtcccactagcttcttggtagtataaatgaatattataaagacccttctcattcttatggtcagcaaatgatacagctactttgtagttgccatccccagtagttacagctgtataccatttaatatcatcttgccctccttgttcagtccaaaccggtaccttaacagcagcgataccgttatcatctttaatattcgtaattaaaatatcaaaacctgtagttgtttcgttagaaatagtcagtctaccagttttagtaatacgggcttgtggttgaggagacactttttctttatcttcagttttttctactgaagatgctttacctagcaaaacaaaacgacgaacaccattgaatgatttataagataaccactgatttccttcaatagttagtatttggtcgtaaaaaattctgtctcctttgtccaatgtaaattgagttggactcgctaccttagcttcattttttacttctactttatgtgaaaatgtataatttccttgcgttgctattttctcttgattattgcttcctgaatttgttacaggagtaggtgctttagtctctgaacctcctgatggatctagtgactcaatagctgcgtatcgacgtacgccacaaaaagacttatatgaaatccatttcacattatctttattaaatacttggtcatagaaaactttatcacctttctttgcatagaaagctactggggctgattttgaaggtgtatttttcacctcggtttctttgctataaacataattcccttgttcaggtaatgttttttccaccattggctttgtctctactaaaggagtagtaatgtcctttgttgccgtattttgactatttacaactttatcagacgcttgaacactatcattattggaagtaatcacacttgacgcacttgtctcattggaagaattattagcatccacactagtgcctgtctgattattaacttgaaccgatgtagtttgatccgcaaaaacaggacttgtgaccattatgaatgaccctaaaattactgatgctaaaccaaatttatatttacgtagagagtaagattgcttagtatcatttacttgtccttttttcatcataaacacctacttccttatttatttacactactattataatatcctttttgtaacatgtcaacatattttagaaatatttgtaatacaaatgtaatattttatgctgtaaatacttctcgaaaaaaatacccaactcttattattcttagtataacaaaatcattatcattaagcatatcaaaaaaccgggcactattctcccggttgattattattttatgctaagtacattttctttagtgtgaattaattgtgtgattaatcgacagtaaggtgtatcaatgcctaggttttcaccttttttattcactgcgccatttaagaaatcaatttcagttaagcgctgattttgaactaagtcttgatgcattgaagggtaatgatgggctgctttaacagatgtatccataacgtactttgttatttcttcttcatcaagctctacaccttctgcttttccaacagtaacaaattcatggataatttcatgtaccatatttacgccgtcttcactagcaaagagttgaccaattgtacaatctagcaaggcgcaagttgaattcatcgttccgttaacacaagcttttctccaaatatttggcaaaacattttcgtcataagtagcctgtaattttgcttcattaagcaattcagtaacgcgatgacctgcttcttgattgttaggatcgatactttgaagatttacagaaccaactccttccagatgagcatgccctggtcctttcaaccctgcagtccaaactgttactcccatcaaaatattgtgttcagggatatattgacgaatgacatcttcatgtcctaatccatttaaaagacataagacctttgttttcttaccaataatttttttaatatcttgaagcatatttggcaactgcattgctttagtaaacaaaataattaaatctgcttcttctgtcgcatcagttggcttcatgataggaagtttaacaaggtcctctgtatcacctgttaccttcaagccattttctttaatagccataatatggtctgcccaattatcaagtaaaataacatcatgatttgttttagaaatttgatatccaaaacgacatcccatagcgcctgaaccagcaatataaactaacatacaacctccaaattaattttgaccttcaaaaacgaaaatatcgtctttataaagtttcagaatgtctttacaaattttgtgtgatacaaaacctactgcaaaaggaataacgagccaagataagataacaatcaacatacttgctcctgcttcaaatgaagcaatcggacctactgcaccaacaagcccaaaaccagacgaagctggtgtccccaccaatttaaacaatgggactgttagagaacttactgtagcagtcataagcattggaatcgccattactggatgctttaggaaatttggcatcatcatcttcattgcacctaaagcaatagcaattggaactccagacttattagccttcatcgttgcccaaactagcactgctgttgttgaagcaactcccattgaagctgcacttgctgacataccattaagaccaatcgctagaccaatcgctactgttgaaataggacttacaataagcattgaaaaagccatcgcaattagaattgacatcgcaattggttgtaaagtagtaaaagaattaattccttgaccaataagtgttgtcacatatgaaacgtaagggagtaatttccatcctaaatagcctacgcctgtacctatgataataggtaacaagataatggttagggaaccaaatttattaccaaaccacttaactgctaaaactgctaaagctgctgttagcatcatattgatgagatcaccaatcccacgcaattggaaactaccagtagcaactcctttttgaataacttctgtgtaagcccacgcaccagaaccaatatatgcagcacctccaacagcaagctgttgcattggggtgaatttaaactgttgaccaatcaaaaatcctgccataattggtgtgaaaaattggaatacctgcacgatgtgtaagaactctgcagcaagtccgtaagataaaaatggtttcaaaaaagtggctaggatagcatttgggatgagtgctacaacgattgcagttgctgtcccacctaacactttattgataaaagaaccagccgtctcttttggtgttaccgtatttgtcataaaatacctcgcttcatttatttaatatcattcataacgacaaagttaattatatcacaaaataaataggaagctttgttatttttttaacaatatatataatccttttttataaacttatcagttttatttatagttattttatcaatgatgttgaatggactacacggttatctcgatcaggataaatataattgatagcttggtttatagcgactggtgcttccccatatcctgttgcaatcaattctacctttcctggataattagcagcatctccaatagcatacacgccttcttgagtcgtctcaaaaagtgaagaaacattgatactagaccgtttataatccaaattccaataacgtaaatttttattagaagtagaaaagccaaaactaacaatcaagttgtctaaaggtaattcaattacttcatcacctttaactttttgaacgaccaagctgctaactctctgactatctccatttaaaccaattgggacataaggggttaaaattctaacacctgatgcctttagtatatccacactatgctcatgcgctctaaaagcatctctacgatgaacaatcgctacactagctgcaatcttatctaattcattggcccaatcaacagctgagtcgcctccaccacaaataacaacatgtttacctgcaaactgttctaactttgtaacgttatagaataaattattatctgcataattttcttcattttccaaacctagtaaacgcggagcaaaagcaccgttgccacaagcaaaaacaatagcacgtgacaaatgttgatctttatctgtttgaattgtgaaaacatcatctactttttcaaatgataaaacttcttcttttaaacagatttcaatagaatctttaaatctctctaattgttcaatatgtttatcaattaattcacgtccagtaatcaccggataaccaggaatatcatagatttttttctcaggataaaggatagctggctggcctcctaattccgaaaggctttcaataattttaacggatactccgcgtagtccagcataaaaagcagcaaagagacctactggtccgcctcctacaatagtgatatcataaattgttttgttcatttactgtatctgttctttctatttctgttttaattttctctaagataagtctctcttcatccgtcattgcataattttctaacaagtctggtcgacgttctagtgtttttcgcaaactttgttctaaacgccattttcggatattttcatgatgaccactcatgagaacatcaggaactgtcatgcctaaataatcatatgggcgcgtatactgaggatattctaataggcccgatgaaaatgaatcatcctgatgacttgtttctttacctataacttctggaatcagacgaacggtagcatcgaccattgtcatagccgccaattctcctcccgtaagaacaaaatctcccaaagatacttcgtctgttactaatgattttatacgttcatcataaccttcatagtgaccacaaataaaaattaattcatcttctttggatagttcttctgcaaaatcctgatcaaatgttctgcccgctgggtctagcaaaataacacgtgctttttgagcatctattttatcaattgtatcaaaaataggttgagcacgtaaaagcatcccttgccccccaccgtaaggctcatcatcaacatgtcgagacttctcagcattttctctgaaattgtgataattaatttcaagaagtcctctttcttttgccttaccaactatagaatgttccagaggggcaaacatttcaggaaataaagttaaaatatcaatcttcatcatctaaaccttccatcaattcaacttgaacacgctgattagaaaggtccacttctaatactactggcgggatatagggtaataaaagatcacgttttccatgacgttccacaacccaaacgtcatttgctcctggttgtaaaatttctttgatttttccaatcagctcttccccttcatagacatctaagccaataatttcatgataataaaattcaccatctttaaggtcgctcagttgatcctctgccaccttcagtgtgaaacctttatatttttcaatatcattaatatgatacattcctttgaattttataatgtcaaaattcttctgcttacgatgactagcaatttcaatatccataacaaactgattcttttcatcgaataaagctaacacttgaccttttttaaagcgttcttctacaaagtcagtcacgcttaatacacgcatttcgccttgtaatccttgtgtattgacaatttttccaacgttaaagtattccatagtaactccgatatttttgaaaataaaagaaaaaccagccgctaaaatgcaactggccacgatagtccgtacgggattcgaacccgtgttaccgccgtgaaaaggcggtgtcttaaccccttgaccaacggaccatgtgaaactggggtagctggattcgaaccaacgcatgagggagtcaaagtcccttgccttaccgcttggctataccccaaaagacaaaatctagtatatcgaaattctagattactgtcaatatcttttcgaattaaattttaaatttcgattttatcccttttaataaagctcatatagagtctatcaaagtattttatgtttcatttttgaaatatattcaaaaactttttggtcccttttttcgataatagcttgtaaaagtagttcatggtactgcttattattcatcccaatttctaatatatcttgtatagccacacctgagtcattttttaaagaagatatatagcgtctctcagcaataatgatatctgctttttttagtaatttttcatctatctgagtcgtttgatagtttacaaaaaagaattccgctatcttagatgtaaaatattggtttaacattacttgataggtttgtaatctaatattactagatgaaattacatatacagaaagaggagctaagaaagtctctattaagttagataattgcattgttagtagcactgtctcatgttttgaaaaagttaaattccctcctttaaggttaaaaatatcagccagacctttatctaataggtgatataaatccttagaatagctcagccttgatgtatttaaaaaataaaaatcaggaataaaataataacaataacaaataaaatgtctcaaaaaataggcattaatatctttaaaatgctgcgagtcaataaattctctacccaataatcgaccacaaaaattcttaaaggctttagactttgatatcttataagaagcaaaaataaattcttcgttgatattgatatcatctcgattgctaaatagaggaccatcactaatacaaaacactaaatatagataatcaagtaaaccttcattcaactctataccaagatgtatagcaatactcttttgagctgctttggataactccatgtagagaatagatttttttagttgattaaaggattctgtttgaggaatttctactttatattcttttcttttccaaactaaattcaccaaaatataaaaatagtaatattcttcagataagtctttaaggtcgtagtcacaccctttaaaattcgagtattcaataaaatcccttatcattacctcacttgtagcatcaaaaggataaataataaaaccaaaatgatactgtaacaaagcaatcagcagcctaatctgatattctggacctgtcactttatttttttgtattgataacttaacactctccaaataaagtttacagtttttctttattcggtaggcacttgcgacggatatgaatttcttagccgtgaattcagaaaaactgacattttgaggagcaataaaatatgccaaaaactgtaacgtattagactctcgataaatggtatgcaaagtctctagcttagaaagtgtttcgtaatggaacaataccattgttctacttttgacaacaaggtagaaatcagaataaagtatttgtagttccgaaataagaccttgtaaaatcttttcactcaaagcatattctgttttaaagtgatcaaggttaatttctccatcatcaagtaaggcggtcatcaggtatgctttcagttttattttttcttcgagaaaatcaaatagcaatatcttatcctccttaataaaaaatcagaaaattccctttcacatccattatattctaaaagactaaaaaactcacaatttttgtgtagatataacaaaaaagacaggaagttcctatcttttagaataaattattctttctcatcaatgatgagtcttacttttttcccttgtgttggtaccgaatagacaatcgaccttatcgctgtaattgtacgaccctttttgccgataacacgaccgatgtcttgggtatctaaatcaagatggtactctaaaaattctgggccatcctgaatttttatggttaactgatctggttgtgaaatcaaaggtttcacaatagcaataatgagattttcaatggtatccataagcttttattattttgagaatttttgatcgtggaatttagtcataactccagcttttgaaagaaggttacgaactgtatctgaaggttgtgcaccttttgataaccattcaagaacacgttcttctttgattgtaacttggttttctgcaactaatgggttgtatgttccaacagtttcaataaaacgtccgtcacgtggtgcacgtgaatctgcaacattgatacggtagaaaggtttcttcttagaacccatacgagttaaacggatttttactgccatttttaaatagtctcttttctttttctttatatttggtcgttgatagcttaactaacaactttaccttactaagtataacataaatacaaactctgtcaagaaaaaatcttgacagagtacatgtttttttattcatatcgtaaagcatcaattgggtttaatttgctggctttattagcaggtaataaaccaaatataattccaataaatgctgagaaaattaaactgcctatagccacgttaagtgacacagaaggagtaatcttatcttgcgcattagcaattaacatcgtacctccataggctagtaataacccaattaatccacccaaaatcgttaagaccattgattcaattaaaaattgagctaaaattttacgtcgagttgccccaagggctttacgaaggccaatttctctcgtgcgctcagttacagagactaacataatattcatcactccgataccaccaactaggagagaaattgctgcaatcgctccaataacacctgtcataataccaacttgggtattgatagatttaactatagatgtcatgtcaaaattatcatagtacccatccttagcatgactaatgtctgttaaacgtttgcctatttctttaccaatgcgattggattgcgatacatcattaagatgaaaatatatgttttctgcttctttagcaccaaactccgaagctaactgtgtattggttaaaatagcattcccatcagaattacttccatataagcctgaaccagcttctggatccgaataaacccccactactaagtaagatttattttttacagtcaccaccttatttaacgctgcttcatttgtctggaataatctctgagctaatttttcttctagtaaaataactctcgagaattggttataatcctcctcttggaattgacgaccacttttaattttgaactttttgataccaaggtaagtgcggttaattcctgttatattaaccgtctttgcctttttttcaaggtaagctactggagcatttgtttgattggttacatagtagccactaacaccatctacttccttagcaatcttttttaaccatgattcttgaataattggttccttacggttggtatcactaccttgcatgaaagccccttgagctccaaagttatcctcatttttttggtcttcttttgttttataataaatctgaaggttcttctgagactttgtaatctcatttgtaaccgaatctttcatgcccttacctaaggccataattaacacaactgatgcaaccccaatgatgatccctaacatggtcagaaaagcacgcatcttgtgccctagaatcgatgatagggcaaacttccaattttccataatcgaatctccccttaatcaattctaatactatcagtagtatctgctgtaatttcgccatcacgaataacaattttacgagtcgcataatcggcgatttctggttcatgagttaccatgataatggttttaccttcttgatttaattccgttaggaactgcataatttgctcacccgtctttgtatccaaggcaccagtcggctcatctgctagaataatagatgggctattcaccaaagcacgcgcgattgctacacgttgcttctgtcccccagataattctgttggcagatggttcatacgctctcttaattcaactttatctaaaaattgttttgctaaatttttacgctttttaggaggtacacccgcataaattaagggtaattcaacattttgtaaagccgttagtttagataacaagaaaaattgttgaaagacaaaaccaatttccttatttcgaacttgagctaattttgtttgacttagttcttcgacacgtttaccatttaaactataatctcctgaagttggagaatccaacaagccaataatattcattagtgtggatttccctgaaccagatggccccatgattgcaagaaattcaccttcataaaccgtcaaatcaatgttctttaagacttgaagtttttgatccccattttgataacttttaacaatctgatgcaatctaatcagttcttttcgattagttgtcacgattatttcacctctgatttcttattagagttaagatcgattgattcaatattatcaattttttgcccatccttgaaggttttacttggattagtaaccacgatttgtcctgctttcaaacctgataaaatttcttgtgtcttagcatcagctttaccaattttgacttcaactttggaaattttacgattagaatcattgtatacccaaacaaagtgtttattatctttgtttatcacagaacttgtagggacaataaggtgcttatctccattaactacttcaactgatacggtaaaaccttgttttaatgcatcgagagggctagtaatatctactttatatttataatttacagcactagagccgttattagagtcattgttgtttgcttctgcttctggataatttgagatatatgaaattttaccttcccattccttgtcaggatagaccttagattttattttaacagcctggtcttttttaacattagccaaatcatactcactcatcgttccttgtacttggagtttaccttcagttgctacatggacaagtacttgactagtttttgaagctggatcaatatcactattaacttcaacaactgtccctgatacgtcacttgtaataacagtatcattcaatgctttttgtgctttatttacttctgcctgtgcatctgcataagcatcattcaaatcttgaagttgttggttgtatgaagcattagcttgactttgataattttgctgtagacgattcgtcgcaccactagtcgattgagtcccttgtccttgtgatgatgaagaagattgatcacttgattccatagctggaagacttcctgttgtctttagattattaatctgacgcgctactttatttaattgacgattagcagtgtcgtaggctgcttgtgcagttgttgtatcatattgaactaactgctgaccagctgtgattttatcacccactttaactgtgacagttgctcgattacctttattagcatcaaaatacacatactgttcttgattagccttagcttttcctgtcaaaagagttgaggacgaaacacttccttctctaacattaaaaactttgtagttagtttttactgcactcttattaggttgagattgtacccataaaaagccacctattactacaattagtgccactgagagccctgatataattgctccttttttactaattcctaaattttgtcgtttactcatgtccatctcctgtttgtattattaatatagaacaagtgtattatttttaaataatattgtcaagaaaattctttaaaaataatatttttactcattaagtatactattttgctcatagaaagaacttacaaaattgaaagtactttactttttaccacaaataaaagctgagatatagatctcagcttttattaagaattgctaaatagactgacaagagatagaaaaatttttcatttttgaaaacatgtctgcttgactttctcccaataaatacacttcttccacctcttctatacccataattgttaatatggtctcaatacctatagtgtcaaaaattatagatgtatcatttaattgttctatgaggagaggttgattggtaacaattaataattctaaatgagtttgtttgatttgcttaattaactcatttaattttactagggaataacccttgtctaccattatcaaagccttttgacaaccgctagaaatgtagtctgaatgccaatcatagcttcgaaaatactgaatttgatggccagttagaacaccagaactttgttcgacttgcttcagaacaggtgcgacactatgtttttttcgatattctaacatgtctatcaaagagatttgccaactactagcaatatagtcatccgaaaaaccataccttttagcttccttataaatatctacattatattggcttttattcaggttttcatacaactctacaatatgtaaacatttatctaagtaaaaagggttgattttagtaactgaggataaatcatacaaatcaaagccacgtctaaaagcctccaaaagataagctagacgattttcttttttctgaatcaaagcaaacatcaaatcttcctcgctaatatcactcagaaatggaaaatgatcatgactgctagcctcgagtaaatttaaaaataattgctctatattacgagcaaaaaagatatagtcaactttttcaaaactaaaagatacggtagctacatagtctaattgcggctctaaaaaggcagaggtatttgggtaataagaatgcttcagttgactaaaagtatatcccactgtcaatttagttgctatctctaaaacaggataggtcgtaatagtctcaaataaaatgctttgatgagacaaaccagatgataaactaattatatgataatccaaactgttcaaatctattaagaaactaaagtaacatactccaataatgtttgcttttcgacacacatcaaatgcaacatctcgaattgtttgcctagcagcatcggataaagtttgacttggtacaatcgctagagacttaccagttgttttattagattcaatatattctaaatcagagacatataaacaattattcaaagagtctctcattactaaacaatctacttgcacaaagtcttgattattgtctattgcctgaacacttttttctgataaattatcgctgatatactgccttgaataatgactctgccacgctaaaaactcttgaaatagctcatgatttttatctaagcaaagggggtaaatcaaactatcttcatgtgtatttatataccccacaagcgtctcaagattttcaaattgtgcatcataatggtgaatcacatggtttagctccttcgagataagaatactaacaggtctatcccttttagataacctctcaacagttgatctaattaaatcgtcatattctttcattttctgtccgaaaataataagcaaaataggctgtttatcctttgtatttagcatatacgcacctccttattaatcagctcaccgactgactttaaataataccttatgtttaagcgcgtgatccaatcatttctaaaaattcatcaaaaaaataggtcacatcatgagggcctggagcagcctctgggtaaaattgcacggacatcactggaaatgagcggtgccttagagcaacaatctcttgatcattcaaaccttcgtgtgttaccagtaaatcatgcggaagatttagccggttaacggtaaaatgattaaactgactaactgtttctaaacgacccgtagcaatatctctcatgggataatttggccccttcttagcaactgggagtctcataatttctgcaccatttgccatggcaattaattggtgccccaaaccaatacctaacataggaacagatttttgtaattctttaatagtgtttaagatttcctgaagcttttctggattccccggaccattagataatatgataccttctgggtatagatttttaataccttctaaagacgtattgtagggaatgacagtcacgtcacactgacgtttagacaattctctcaaaatagaatgtttaagaccaaaatcaagtacaacaatatttcgaccgctagcaggcgacggataagctgtttttgtcgaaacttgttccacattatttgtcggtaatactgtcgctattaattgatcctgtaaatgtgataaaacatcacctgcttctgctaaagtagcttttacaaatcctttttctttaataacttgcatcaaataccttgtatcgacccccgacattgcaggaacctttttcattttcaaaaattcatctagattcatcttgctagtatcgctacttacacatctggaatactctgcaacaacaactcctaaacaagtgggaataatggcttcagagtaactgcgatgaataccataatttcctattagcggtgaggtaaaaactaaaatttttccattatgtgaaggattcgttattatttcctgatagccggtattccccgtacaaaaaactaattcgccagttacatcaagagatgaaccaaaggatagtccttcaaaaaccgtaccatcctctagaattaacaatttttttgccattgtggttcttccccttctataaaatcatcgtaaataatagtcgtctacttaactcggatcaataatactcacacgatcgtaaccatcatgttccatcacttcaactagaatttcttcaaattgacttgttggaatatttttccccacataatctgcacgaataggtagttcacgatgcccacggtcaattaatacagctaaactgacacgactcggacgccctaaactaacaagattatcaatagcagctcgaatagtgcgacctgtatagagaacatcatcaattaatataatatctttatcagtgatgtcaactggcatagttgtggtgtcaacttcaactttcatatcatcacggaaaggtttagtatccaattctccaacgggaatatctaaattttctaattgcttcaagcgttcttgaatgcgtttggctaaaaaaacacctcttgttttaatgcctgctaagacaatattatctaaatttttgttacgttctataatttcgtaggtaatacgtgtaatagcacgtttcatggtcacatcatcaataatttcttttcttttcattgcagtatcctctctaagataaaagagccccttcaaaaggagactctctagaatgacaaagccgctcaggcattgatttagtctgaagtttctccttaactatctcactggataaggttaaaggaatgatttgcttatattatagcaaatggtaaaagtatttttcaagaaaaacttaattttttctcaacttttctaaggttgtctgaaaaatttccggaacctctactgaaaaaatcaaattctctccgttactagggtgcgtaaaacctagtgtttgtgcatgcaaaaactgtcctttaccccctaaagtcttacggggaccgtagacaggatcaccggctagaggatggccaatataagccatatgaacccgaatttggtgtgttcgacctgtctccaatgacaattcaactaaggtataatcaccaaaacgttctaaaacatgaaaacgagttattgctggcttacctttagcagtcacggcttgcttcttacgatctttatcgcttctaccaatcggagcctcaatcacacctcgatcatttggtaaattaccatgcacaattgctaaatatttacgaagcgattttttatcttttaactcttcagccaacacttggtgagctctatcattttttgcaaccatcaataaaccagaagtatctttatcaatacgatgaacgatccctgggcgaacaacgccattaattgatgataaatccttaatatgatacatcaaggcgttaactaaggtgcccgaactgtggcctgcagaagggtgaacaaccatcccttgcggcttattaaccacagcaacgtcatcatcttgatagataatatctaaagggatattttcagcttgataatctagtacttcctctttaggaatatcaaaagtaatccgatctccttcttgaacagtatatttcgctttttttacttgtccatttactaacacaatcccttttttaatttcttcattagcttgactacgcgacagttcagaattatccgctaaagctttatctagcctaactcctgctattttaattgtgatttccattactttcctctttccaaagtgcaatcattaagcaaataataccgattgtcagatatgagtctgctacattaaagatagcaaaattaataaaatctaaatgcaccatatcaacgacataacctaatcttaagcgatctataaagtttcctaatccaccagagatgattaaggttagagaaattaataaccaataacttccattaatatgtttcatcaaataaataatagcaacaccaacaacgaagattgtaattaaggtaaaaagccattgttgattttgcaaaatagaaaatgcagcaccataatttctcagataagttagactaacgatatttggaatgaattccttaatttggtttagttcaatatgtttaacaatccataacttagatagttgatctaaagcaatcaacaaaatagttattattggtataataatctttctcattacttctcctatgaattaaatcccttaaaatactcttccataacagcaacaaattttaaagccatctgagataaattacgatcttttcgtttgatataaatcatttggttatctagatgatcttctaatggaataacagtgataccattcacactgcggctatccaagaatcctgagcccgtcgcataagcttgggttctttctaaaataccatttaatgttgctctatcagtaacattataggtaacagaactatcaagtacttccacaaaattctccgagtaataccgataatcatctctatcctgtgtaaaacgtacggttggtaatccttctaaatctgtcattatcagagatgttttactagccaagggatggtctttcccaagataaatatgagttttaaaaggaataagctctacaaactctaaccccaatttgtccaaccgctgaagtagaccttttttattttgactattgatataaatgatacctatttcgctattcccttgagcaacttcatctaagatacgtattgttgttgattcgaaaatacggaaatagctaaaattatcattacattttgaaaacgctgtgattaaaggaggtagaaaatcataatgttgacttgctattgagaattcttgctctgtagcttcagattgcgaaaactgtttttcgaatgaatcaaagcttttcacaacttctaaagcattctcataaaaagtcatgccttgattggtcaacactgcaccagtagttgtacgcgtaaaaatctgaaaccctaattctgtttccaaatcacgaacggcaacagataaacttggctgactaacaaatagttttgcagctgcttcacgaaaagtaccactatttgcgatagcaacaacataacgcagttgttgaatattcattttatcacttcctcattttagtacccttcattataccaaaaaataactatccttgcggaaaattcttcatgaattaggactatttcactataaaagaacaacaaagtttatgagtattaatgataaatctcttaacatattgtcttttgttacaaaatgaaagctctgacaataataaaagaccttatgaatagtcataaagtcttaactaggcattattttgcgattgggtaaacagacacttgttttttatcgcgtcctttacgttcgaaacgaacaacaccttcaactttagcaaaaagtgtatcgtccccaccacgtccaacgttagcacctggatagatgtgtgtaccgcgttgacggtaaagaattgatccacctgatactgtttgtccgtcagctgctttagctccaagacgttttgcttgtgaatcacgtccgtttgatgtagaacctccaccttttttgtgggcgaaaagttgcaagttagcaagattcatttttaacataatgttgtgtcctctcttaaattagtgtgtcatgactactgtactaacaaattcagaagaatctttagacagattagtcattccaagaaggtaagactcaaataataattgaaccttatcctctttatgttgtggtatagaagataaatctatcttcatataaccaccttcaacgtcattgataatcaattgcgcttggcaggttgttaaagcctctaatgaattaataaaattaattgataaagtactaacagctgcacaaatcacatcaaagccgtactcgccactaccagcatgaccgctgatttcagcactataaagatagcctgattgattacgagtaaaagttgctttaatcatgaaaaattaagcgttgattgcgttgataacaacttttgtataaggttgacggtgaccttgtttacggtggctaccttttttaggtttgtatttgtaagaaacaactttcttttgtttgccttgtttttcaacagtaccaacaacagtagctccttcaacaactggagtaccaactttagttgtttcaccaccaacaagaacaacttcgttaaatgtaacttctgctcctgcttcaacgtcaagtttttcaacgtagatagcttgtcctacttcaactttaacttgtttaccaccagttttgatgattgcgtatgtgctcatgatgcacctcctataaaaatttcttgtgaggtttccctctgtgaagactcgcctataaatcgtgagagccttgctctacttaatctaacgattttcgcgcggttgcacaggatgtgcatttagtcaacattcaaattttatcataaactctttttttatgcaagataaaacaaaataaaattatcaactttaccacttcaaattaactaactcattcatctccttatatgctttatcaactttatctttcatagtctgatcaatcgtagaacgtttcttaccaccttcaatataatcctctaaaactagcgtcctataatcataagctggaaagccttcttcaacataacggccatttggttttgcttctactagtgttggatgcgccttaacttttttaattactgttttttgaccttttttctctatggttacatccattaataatcctctttctgtccagatatcatcaaccgtttctaaacgctgatttgaaataaaatttcccatagagtaaataataaattttttctggccatctttttttatcacttcagacggttcaacaacgtgagggtgtcctccgaatataatatctgccccccatttaatcatactatgataaagcattacttgttctgtagtaggttttttttgatattctatccccatctgtggcatgacaatggtgatatctgcttctttttcagcctttttaatatcttgcttaatctttttagtatctaaatcagacatatgtttttcatagtcactctttgaaacattagcttccataccattgtagccatacgaataacctaaaatagcaattttaataccatttacatgcttaattaagatatcttctttatttctatcctttaaataaaccccaatagtatccaatcccagacgattaaaagtcttgacagtattgatagcacctgccagttgtgaatccagaatatgattatgtgctaagtcaacgacatcatatccagtttctttcatagtagttgcaatctcattaggagcattaaataaaggatagcccgctaaaggatattctgaactaatcgtcccttcataatcaccaatcgctaaatcagcgctctcaatccaagattttacctctttaaaataaggagtaaaattataagtgccgtcgggttggcgcgcactggcatatagtacatcgtgcagcaaaatatctccgtttgcaaccacacgtgctgtttttacagtattattatttgcaaccttttgccctttagattgtgctaaatccttagataaccccaaaataaaaatagcaataataacggctacacaaaaaataagtgttttctgataagggattcttgccatacttgcctcctttattcgtattatagcattttttataaccttatgatagcgcaatcattttaataaaaaactacagagtaaatctgtagtttaaaaattcattataataaatcgtcaatcaagtcatcaacatcatcactatctgcttgaggttgaatagtagttaccataatccctgcaactgccctctctacaagaccttctacatccatacgtttctcatactgttctgtattcttaattttagggttagtttttgggcgatctggtgcaaaaatcgtacagcaatcctcaaatggttgaattgaaatatcaaaagtatctattttttgagcaatatcaataatttctagcttatccatcgtgaccacaggacgaataatcggtgttgcagtgacagcattaatagcttgcatactttctaacgtttggcttgccacctgtcctaaactttcaccgttaataataacaagaccatttcggtcctcacgaatacgatctgtaatacgcatcataaacctacgtgttaacgtcatcaagtaggcttcgggagcttttgccttaatttcctcttgaatttctgtgaatggaacttcaataaattgaatattaccaccaaattttgtcaatttacgtgttaaatcatgtgcttttttcaatgcacctgggctagtataaggaggacttgcaaaatggactgcttctatatctacaccacgttttaacgctaggtaacctgctaccggagaatcaatcccaccagacaacatcagcatcccttttccagatgttcctactggtaatcctcctgcacccctaatatcctcatatgaaatataagcagcctcatctcgtatctcgactttaagattgatatctggttgcttcatctgagccttaatatttggcaagactgaaaaaacagcatctcctaaagtatgatttagagcacggctatccaattcaaatgagtggtcactacgttttgcggtaattttaaaagtcatcccatctttataaacggaagtcataatttcctggacagcttttaccaatgtatcaacatttttttctactttaaaagatggagaaaaagcttggataccaaaaatctcttttaaggactctgcaacttcatgataatctgtaccattgagatatacatgtcctctatcacgatctgtttttactgaaacatctggataaatggagagtacatgctccatattattttttaacttattgatgaagcgcatacggtttttcttcttagtagagagttctccataacgaatcataatttctgaatactgcatcttatcctctaactttcttagttttttcataaacttgtttaaaaatagttaaaaattgctctacttgtcccatatcattatcatcatctaagctgatacgtacagcagtttgggctaacttagttgaaattcccattgctataagagttcctgctggtttacctgctttagaagagcaagcgctagttgtcgagataaaaatatcatgtccctcaaaggcatggacaagaacttctcctcggacacccttgataccaaacgtgataatgttaggtgaaaaatcttccttacccgaaaataacgtaatatcctcatatttggctaattcatcatgaataatggttttcattttacttattttaggaatagctactacttccttgtccataaccattcgtaaagctttagcagtagctgcaatccctgcgacattctcagtagttgaacgtaaatcagtttcttgtccaccacctgttagtaatggtgaaatacgttttccttctttaatatatagaaagccaaccccacgaacgccgtgaaatttatgactagaaaaagatgcaaaatcaactcgctcagtcaaataatctttagtcggtatcttacctattgcttgaacagcatcaacatgaaacgatatagtaggtttatctgacaacaagtctgaaatagcttttattggctgaatagaaccaatttcattgtttattgccataattgaaataagaatcgtttctggtttaattaatttgaccagtgcttctacgtctacaaatcctttatcatctactggcgcataatcaatctcaaacccatactctccaagccatttagcagactctttaacagctgggtgttcgatatcagaaacaataatatgatttccaaaatgttgtttctcaaacgcaagacccttaataacccaattatcggcctctgtaccaccagaggtaaagaaaatttcatttgctttaagctcaagtaaactagcaatttgtttacggctagcctctaaaatccgagaagatgttgttcctagctcatgtaaacttgaggggtttccatagattttactagctacttcttgataagtccttaaaacttctggatagggaatagtagttgccgaattatcaaaataaatcataaatctgtccttctaaagtcaatcagtgttattatagcataattttcctactatttatattagtttgtgaacatcccaaaacaatatttatgataattctcataatttatcacaaaactcactacctattacactaacatagcttaataacctaggttgcttatttaaatgttttaaattattttttctttagctttttttaggataaaatcatataatagttgatgtacatttaaggagggcgtcatgtcaaaaggatattcaagacaacagaaaaagtctactaagactaatactgattcaactcaatcacccgctaagcatataaaaacaggtttttctgcacttcaaaaaacaattgcattagtcggtagtgttttaagtattattgttgcctctattactattactaatgcgattaataatcacaaagactctagtaagactgattcttctacttcaaaaaccgtcattataagagaaagtggacaaaattctagtaaccaagtttctactgaaaaagatgagacaagggcatcatccagccaaacactagaaaattcctctgctagtagtactccgagtagcagttcaaattctgctgccaataacgatcaaacatcatctagtactaacaatgatcaaacaaataatactactaccgatacctcaactattgaaaatacaacaacaccttaaaaaagctaggttccctagctttttttgtattctttgatagcgttagcgcattgtaacaaattcctcagatccagttgggtgaatagcaacagtatcatcaaagtctgctttagtagcccccattttgatagcaactgaaaaaccttgaatcatttcatcaataccataaccaacaccatgaagcccaataactttttcctcttttcctagggttatgagcttcatcttaactgcttggcgattagtggtaacagccgtatacatagaggtaaaagttgatgtatagactttgatattatcttctccaaattgctcgatagctgctgcttctgaaagtcctaccgtcccaattacagggtgagtaaaaataactgaaggtacattatggtaatctaatttttcgttatctttatgattaaaaagtctttctgataagcgacgacctgctgcaattgctaccggtgtcaaggcaattttcccattaacatctccaatagcatacacgccatctacagaagtattctcaaattcatctgctttgatataacctttatcatttaaaacaatatcggtattttcaagtcccatgtctacatttggtccacggccgatagcccatattacacgatcaacgacaagcgttttcccattttcagcttcaaaaatcaacttgccaccttcatcgcgtttaagagatttaggtacatggttagcatgtaaagagatacctgatttctccatttcagccataacctcacttgttaccatgtcatcaaatccgcgtagaatatggtcttttctaaatgcaagatgggtttcaacgcctaattcattaaccactccagcaagttccgccgcgatatagcccgccccaacaatcaatatagaatctggtaaggtctcccatccaaaaaaatcatcagaagtctcaccaagttcacttccaataatatcagggtaaagagggtgtccacctgttgcaatagtaatgtgaggagctttatattgctgaccattcacttcaatagtatggttatcaataaaacgagcaaatccatcaatcttttcgactccattacgctcaaaattagcggcatacgactgtctagaccgctgcacgtaagcatcgcgattagcttttagagtagtaaaatcaaaattaagattattgacttcaaaaccataacctgaactatacttatggagtgtctcagaaacttgtgcaccataccacatgattttcttcggtacacaacctaagttaacacaagttccacctacttgtccaccttcaattaacaggacttttgctccatacatggctgccctattagcggtaccactgcctgcactacctccaccaataacgatataatcatattgttttgacattactctctccttgaatcattgatacctatactctatcacaaagtgtttacagtcacaattttctgctacgtagaatgcaaaaccaatataatgtgggcaatactagttcagtagactatcataaattgaaatattataaaagagaaaactcaaggagctctctcttttataatattacatcaagtcctgcatgggtgcaaagacaattttttcgatatcagacatatagacagacaaccgttgttgttggtcaaaataaacttttaaaaggtcattggattcaattttttccccaagtttagacatttcatcttgttcttcttgacttggcatttggccagattgcatcatttcttgaacttttgattgggtagccaaaaagtcttgccaaagcacttgtgcatccgcatcactttcaatagctgattttgcagttaaaactgcttggtattctggtaaagcacgaacagcacgttctaattcatttgctaaatcatatacattagccataagttactcctttttctacttgaacttaccactattttagacttttatacctttttttgcaattgaatactactagttttcatttaaaaatgatcaacataattgcgatatagttttacagcttcttttagttcatacatgttgtctgaagaaaatttttctagcacttctgtcaccaggacggtggctactacagcttccataacgacacctgcagccggaagtgccgtgggatcagaacgttccactgtagctctataaggctcgtgagtatcaatatcaactgacattagtggcttgtaaagcgtaggaattggtttcattactcccctaacgataataggctctccattagtcataccgccttcaaaaccgcctaaattatttgactgacgtatataaccttggtcctttgtccatgatatggagtccattacttgacttccttttaaaaaccctgacttaaaacctagaccaaattcaacacctttaaaagcattgatagatacaactgcttgcgctatcttagcatctaactttctatcccagtgtacataagagcctaaaccaacgggaactcctccaacgatagtttcaaccactcctccgatagtatctccagcctttttcacactgtcaatataatccttgatttcttgttcgaaggatggattgacgatagctacttgcgattgactagataacactttgatttgttgaactgttagcttatcagggacagtaatctccttgccaccaaaaactacaatatggttggcaatttcgataccaatttctttcaagatacgtttagcaatcgcaccaatagctactcgcattgtggtctcacgagccgaagaacgctctaaagcatttctcaaatcatcgaaacggtatttaattccacctactaaatctgcgtgcccaggtctaggatgcttaatacgacgtttttgctttaggcgctcttcaatgtcttcgactgacatgatgtccagccatttgctatgatccttattagttactgtcagtgtaataggtgaacccaaggtttttccatggcgcacaccagaactaatgatcacttgatcagtttcaattttcattcgattcccacgaccataaccaccttggcggcgttttaaatcttcattaatatctttagcagataatttcagtcccgcaggaatcccttcgataatagctgttaaactaggtccatgtgactcaccagcagttaaatatctcatctatttctccaaataatctctcatttcttctaaaggtatttggtggactgttgcactacctaattgaggcagtataacaattttaataaattgtccacttgcttttttatcatgactcaatatgtcaaataagacgtccttatcccattccgcatagtggaccggaaggccaaattttaaacacatattataaatatcttgactgatacctcttggcataagatttttacgctcagccacacgagaaagctggatcattccaattgcaacagcttctccatgcattatttctccatagccagcatgtacttcgatagcatgaccgatagtgtggccaaaattcaaatgcatccttaaccctttatcatattgatcagctaaaacatgctttcgtttaacttgacaagagtgataaataatagctaatgcattatcaaggatactatcaatagtcccatccatctcttctaaaatatgccagagttttatatcatcaatcaagccatatttgatgacttctcccataccttcaactaattcacgattgcccaatgtttttagagtaacaggatctatcagtacaccatcaggttgtgcaaaagtacctaccatatttttagcgaatgaagtgttgactcctgtttttccgccaatggaagaatcaacctgtgctgttaaactagttggaatttgaagaaaatggattccccgcatataagtagaagcaacaaacgctgctaaatctccgacgacgcctccaccaagtgcaatgatcccatcgcttctggtcatatgatgctttgctaaaaaagcataaatacgattagcaacttccaaagttttactagcttcacccgcagcaaaactaaaaacatgtactgtaaaaccttgtttttttaactggttgacaagcgactccccgtataatatttctacgttactatctgtgataatagttatcatttgtttctgccataaatgtgatacccagtcaccagcctcagaaaaacatccttcttcaattttaatatgataagggtgattcggtaagtcaacttcaacctgcattctaatgtcctctcatgtttgttttaataagacaaaaaccctaagcaattgctagggatctcatcagtatatttaacattttgttatctcgtatcagtcagcgtcaagcaatgctttgacacgcttcatctctgaaatagtaatttgtccgggtgcgatagatgaatctaaatatgcaaatgtccaactagatccagttacatcaccagcaaaacgagaaatacgtccaattttactcatagataccgtcgcataaacttgatcaggattaatagtcttgaaaccgcgagtgtaattcataacgtctaagacatcttgttcattctttggcattactgcgattttcacaactcgtggtgctagggctgttaattctgaaaatatctccataatattctccggtgtctcttgaaaattgtgataagacaggactaaatttggaaattctagcatttcttgaaaaacttctttatgtgaaaaatactcaaaatcaatataatctggattgtagatagaattaattttctggattaactcaacatactcagcatcagataagacaatattaccaccttcacgcgttgtacgaagagtaaaaataatttcatgacctgcgaatttctcaaaaatagctggagctacattaataatgtcatcctttggtaaggcatcagctcgccattcaataatatcaacactatcaaattttgataaatctatttcttgagcctcttcaagactgcgaggcattactggtactactattttcattattttacctttattgtaaatacttttaaataattactttgttggtccttatcatttatagtgaaatcttcaggcaactgctgtaagctaatgtaattatgtgaagctttaccaaaccccttttccaattgtttcttaaattgtgatacggttagattagctgcgttagttgatgcaatgatagttccaccaggggttaaaatatctaaagcttgttcaattaatttatagtaatctttagtaaccgaaaaagtttgttttttatttcgagcaaaacttggtggatcaataacaatcacatcatatgatagatgttttcttttggcatacttataatattcaaaaacatccataacgataaatcgatggttatctgtgacaatctgattagcatcaaagtgtgcttttgaaagttcacgcgagcgttttgctaaatcaacagaagttgtctctaatgctcctccaacagctgcagctacagaaaaagccgcagtgtatgaaaacatatttagaacttttttaccttctgatagattagttgctaaggcttttctgacatcatgttggtcaaggaaaatacctgtcattaatccatcattcaaaaagacactatatttgatattattttctaaaatcaaaaatgattcaggagcctcttgaccgtacaaatgagcactttcaaagtctaaacctttgaaacgaattttttcatatgcccctttaatattaggatagacctgcttaaaggctgcaacaatcatttgtcgattagtataaacaaattcattgtaccacgaaaaaagagcatagtcactataaaaatctatagttaggccaccaaagttatctccatcctgattaaacaagcggtaggctgttgtttggctagatttttcaaatttttgacgcttctctctagatttttcgaatagcgatacaaagtaatcatggttaaaatcaaaaacttgtcttgatagtaaccaaccaatacctttattttgtggtgaaagataggccatccctaagaattgatttgactgtgaaaaaagttgaaccaactggttaactaaactggtatcaaaatcttttttttccagtaactgagcacctgatttgatttttctttcaacgacagaattcactttaagtttattcataaacagtattataacaaatttttatcttttttcatactgaattcgacctttctttaccgtatgttacaaaattttatgttataatttaatctgagattttatctttaggaaaaaaattaaaggaagttcctactgtgaaaaaaattaaagattttgctagccgtgcgatcaatacacgactcggctttattttattgttagtagttatatattggttaaagacaatttgggcttaccatactgattttaatttaggtttagaaaattcctatcagttgtttttgaccattataaaccccatccccttaggactcttaatcataggtttggccttatatgttaagcgaaccaaagctttttatattaccgcttttatcacctatgctatcgtaaatatccttctaattgcaaacgcaatctactatagagagttttccgatttcattacagttagcgccgtcttggctagtagtaaaacttcggctggccttggagactctgctcttaatctattgagaatttgggatcttgtctacgttttcgatttcattatccttattttcttatttgcaaccaagaaaatccacttagatgatcgtccatttaataaacgtgctagtttttctatcacagctttgtctggtttactcttttcaattaacttattcttagctgaaattgatcgtccagaactactaagtcgtggtttttcaaacacctatattgttaaagctcttggcttgccatcattttcgatttatagtggtaatcaaacttatcaagcacagaaagaaagaaatggtgccactgcacaagaattagcgactgccaaaaaatatgtagcagagcattatgccaaacccaatccagaatattatggtatcggaaaagggcgaaacgttatcatgattcatttggagagttttcaacaattcttgattgactataaattaaatattgatggtaaagaacatgtggttactccatttattaacagcctttatcattcgaaagagactgtctccttctctaacttcttccatcaagtcaaagctggtaagacatccgatgctgagacactcatggaaaactcactttttggtctaagtagtggttcattcatggttaattatggtggtgaaaatacacaatttgctgctccacatatcttagctcaaaatggaggttacagtagtgcggtcttccacggaaacgtcggaacattttggaatagaaataatgcttacaaacagtggggttatgactacttctttgactctagctacttctcaaaacaaaccaaagataattcattccaatacggtttgaatgataaatatatgtttgctgactctatcaaatatctagagcacatgcaacaaccattttatactaaatttattacagtaagtaaccattacccttacacaagtttgaagggagagtctgacgaagagggattcccacttgcaaagactaacgatgaaacgattaacggttattttgccacagcaaactaccttgatacagctcttaaatcattttttgaatatctaaaagctgctggtgtgtatgataattctattattgtaatgtatggggatcactacggtatttctaatacacgcaatcctagcttagctgaattattaggtaaagaccctgaaacatggtctgaatacgacaacgctatgttacaacgtgttccatatatgattcacattcctggctattcaaaaggttttatcagtaatacatacggtggtgaggtagataatttaccaactttacttcatattctaggaatagatacgtctaaatatactcagttaggacaagacttattatctaaagataataaacaaatggtcgctatgagaacaactggtcagtatattactcctaaatacactaactatagtggacatctctattacactgattcaggacaagaaatcacaaatcctgatgaaacaactaaagctgaaataaaagctattcgagatgctactaataaacaattatctacaagtgattcgattcaaactggagatttactacgatttgatgaaaacaatggtttgaaaactgtagaagttgaaaaattcaattacacacattctcttaaagcactcaaagctaaagaacgtaaattgaaagatcgttcaacaagcatatacagcaaacataacaacaaatcaacagttgatctcttccatgctccaagttacttggaattgcaagatcctaataagacacataaaacatctaaaaaataatccttgccatttaaagtttaatccacacctcaatccaacgattgaggtgctttttatacggaataatactataaaacaataaaaatcaaaaaggaaaattataacaataataaatatatcgaaataaaacaaaaaagtttcattctacatatatagaacgaaacttttcactaaaattataatataggtactttctttctagtaattaaaaaaagttaggcaaacccaacttttttaattcttatttaccaagtttagctttagctgcatctgcaagagctgtgaaagctgctgcatcgttaactgctaaatcagcaagcattttacggttaacttcgatttcagctaatttcaaaccgtgcatcaattgtgaatatgataaaccattcatacgagcagccgcattgatacgagtgatccataatttacggaagtcacgttttttctgacgacggtcacggtatgcatagtagtaagaattcattacttgttcttttgcagtacggaacaagatatgttttgcaccatagtaacctttagctaatttaagtacgcgtttacgacgtttacgtgaaacaactccacctttaacacgagccatttatatttcctccaaataatcctttataatatgtagtaaatgtttacagagaccttattatttaaggcgagtaagcattgctttaatacgtttgaaatctcctgatgaaaccatagtagctttacgaagatgacgacgttgttttttagttttaccgtggaaacggtgtgaagtaaacgcgcggaagcgtttcaatccacctgaacctgtgcgtttaaagcgtttagctgatgcgcggtgtgttttttgttttggcattttaaattctcctcttaaataatactataaagtcgacaattatttcttgtctggaattggtgcaagctgcataaacatttggcgaccatccatcttagctctttgctcaataatagcgatatcttgtgtcgcttcagcaaattccgccaatacctttgctccaatttctttatgagtaatcatacgtcctttgaatcggatagaaactttaactttgttacctttttcaaggaacttacgaccgttacgaagttttgtttcaaaatcccctttatcaataactgggctaagacgaacttccttaacagtaacaacgctttgttttttacgttgttctttttgtttcttttgatactcaaatttgaacttaccatagtccataattttcgcaacaggtggtgtagcttgtggctgaattaaaactaaatcaacattagcatcatctgcaattgcttgagcttcagacaatggtttaatacctaattgttcaccctcgagaccaaccagacgaacttcacgaacgcgaatttcatcgttaatgaatagatcttttttagctatgatcttcacctctttatttttttagagaaaaacgaaagcggacttgataaatcaagcccgcacatataatcttcctagatggaatcttgacatgttgggccagacaacctaagtcgcaaggcgagaagttctcacttctgcttttctcattgcaactagtatatcatgactaattcttcatgtcaattattttttctgctttttcttgaataaaagttacaacaccttcaattgatactcctgtagtatcaaattcaatagcatcttctgctgcctttaatggtgaaacttctcgatggctatctttataatcacgagcagcaatttctgatttcagtgtttcaaaatcactctcaatgcctttttcttgattttctttaaagcgacgctcagctctttcatcaacagaagccactaaaaaaatcttcaattctgcatctggcaaaacaactgttcctatgtcacgaccatccattataatagcaccatctttggctatacgacgctgctggtttactaactcttctcgaatctctgggatagcagaaacccacgagacattgttagtaacatcgttttgacggatagctaaagtaacttcttctgtgccaagaaagactgtctggctgccatcttctgctttaccaaaagaaattggtctttcagctaggagtcctagaattttcgaaacatcttgtgcttcatatccatgctgtaaagccagataagtagcacaacgatacatagcacctgtatcaaggtaagtgtaattcaaatttttagcaataatcttagcgacagtactttttccacttgatgctggtccatcaatagcaatattaattgagttcataatcctccccttaatttacaaccacaggatcgcctggattagcataccaataccctgaggtcatatgactgggattaagttcttgtaaacgagcaactgagatacctgcacgagcagctatggaggctgctccctcacctggttgaactacgattgttccaccgtttactgaagatgatgtcgatgtctcactcgaacttgctacagtactagaagatgttgttgatttatcactagttttagtttttgatgatgacgttgttttcttacttgtagatgcttttttcgttttagaactattaactttttggcttgaagcaccataaaaaccagaagtttcttttgctctgtcttctcctctatttgaagtataaaatactataaataaaatagcaacgacaataacaaagaatgcactcaagaaagcggtaatccaaggagtacttgacaccacacctctactcgttcttgtaattttgtcttttctatgactattgttttccacaacttttttttcccatggttttttcgccatgacttcccccttgttaatcgtatcaataagtattacaataatactatgaaagttgcactaattccagaaaaatgtattgcctgcgggctttgccaaacatattcaaatatttttgattatcaagatgatggtatcgttaaattttccgatacagataacctagaaaaagaaattccaagttctgatcaagatactgttttagcagttaaatcatgtcccaccaaagctcttacgattttgtaagagcttttttatcgtagcgataacattcaaaataatccattttaatcaaattatcgagaagctccacttctcccttaaatgtaggttcaatagctagtgcatctaaaaaatattttttaggccattttcgcatgtaaaaaatacgctcatggttattattaaatttgatagtaacacttgatttagtgacctcaattttagcaatatcttcaattggaaacttagttcgtcttaaaaagttaaaagatacaatcctaagatatccgtcttcttcaataacaaaatagcgatgaaatccaatgcccactaaaacaataaagatggcaaatagaacaaatacctgactcggaatctcagttctttcatatagcagagataaaccaataaaaattggtgcaatggctattgaccaataaataatagcccaagaaagttcaggttgccagtgataacgtatcttcccaaataattttatcatttaaccactccaatctgatatttctttactaatccttagcaacgatgcctaaaataacatcaactgctttttccattgtttgtagactaacgaattcaaagcgtccatgcatgttttcaccacctgcaaaaagattaggagtagggattcccataaaggaaattttagagccatctgtaccaccacgaatcggttctatgattggcttgatgtctaactcttccattacttctttagcaatgttgataggtgtcatgtctttttcaataactttcttcatgttgtaatattgatcgtatagtttaacctttacacgttcagattgtaatgcttcattcatattatcagcgatatcttgagccaagtgcttacgctttaagaaatcaacttcctcaaaatctcgaatgatatatgaacttttagcttgatcaactgttccacttaaatcatataagtgataaaatccttgatagccatctgtttgttcaggacgttcattttctggtaattgactatgaaaatccatagcaagctgtaaagcattaatcatttgattttttgcagttccagggtgaacgtttcgtccttcaaatgtaagctccaaaccagctgcactaaaggtttcatactgtaattctcctagtggtccaccatccactgtataggcaaaatcaacatcaaaatctttaacatcaaatttatctgcacctataccaatttcttcgtctggtccaaagccaactctaatttcacaatgctcaatttctggatgcgaagccaaatattccatagctgtcatgatttctgctataccagacttatcgtctgctcccagtaaggttttaccatctgttgtaatcagtgtttgcccatggtaattatttaaatttggaaaatcttttggacttaaaatgtaacctgagtctccaagttcaatatctccacctttatagtcaacaatttgtggagtaatattttcagcattgaaatcagctgtatccatatgggatataaaacctattttatggcgtaagcggtcgcttgtagcaggtaaggttccaaccaaatacccattagaaggtaaataatgaacatcttttaaaccaattgcttccatttctggttttaaaactgttaaagcaaagtcaacttgactttgagttgttggcgtttgtgtactattaggattacttcttgtatttattttgacgtatgttaaaaatcgttctaaaagcttttcgtaagacatctttcacctcatatttctccatttaattataacataaaaataagctcactatattgtgactaccttaaaatttcacaaataattttggtcgtcaaaaaactaggttaaacaattctgtctaacctagtttttcattagttaaggtgcaactttcggcgtaagtcttgagcacgactaccaatcattttatcaagtagatgggtggccagtgccataaagccatatacccctaaacctattgcaccgataacgataatgtaaactagacttaccagtctactatcgggtacaataaccagattcattaaccatattatcatagaaataataaagctcatcaatagcgttagaataaggactaaagcacttgtacgacgaatagcttggcgtttaaatcctgtaatttcatgtattttcaaatacataagaattactgggatacaaagagctactgtcgttgagaaaagtggtccataggcatggaaaaggaaaatggagggaagttgtaaaataacttttgccaccagaccatataggaagtaaataatagctttacgattttcaaacaatgcttgtagcattggtgctaaaacagtataaatagataaaataattgtttgaataagagatatgacaaaaagtcctaaagcttgtccctgcggtaacccataaaagactgtatacaaaggttttgctaaaataacggatcctgcaacagctggcagtaaaaacattagtaacatttgtagattattaacaaccaaacgagcggcggcttttttatcattcttaacaaaattctctgttaacaatggaataccaactccagcaattgcggtagcaacagcaattagaatcatcgtaactttaccagggttgcttgaaaagtaagcaaacataacccgtaattcttcacttgaataattcgtaaagagcgccatcgtattcccaaatgaaaactgatcaatcagtttgaaaatttgaattgctgcaccagtaataataaaagggattgcttccttaatagtctcaattaggatttctttagtatctaatttaatgtgctttggagttttaccaatcaaggcagatagcatattataacgccataagaaataaagcagcacagctatactagcaaacataccgacaaaggcggcgaatgttgactgtgtcacagcggcaatataatctcctgatcctagacgcataatatagaaagcagttaataacatccatatgacacgtataatctgctcagcgacttgactaatggcatacggttttaaattattaaaaccttgaaaaaaaccacgtaaaacactcattgaaggaaaaactaaaacagctagagttagactacgcaatattggaacgagttcttgccctcctttactaagtgaagcaaatagaggtgaaccaatatacataattaatgcaaaaattccacctaaaatcagcataaactgcaagattttccgaaccagataaatgctcatctcttctttacctaaagtgttatacttagatacctgttttgcaactgctactggaattccaacagttgatatcaaaagaaataaagcatagatttcatatcccatcccaaataaagcatttgcttcggcagcatgctttcccatccaagcataccaagggataatatagatggctcccagcaagcgactaatgaaattccctgctgttaaccaagccgtccctttgaccatttgttcttgctgactaacttttgttgttttttgtgacatggtaaactttctattttcaatattatttagcatttaaaagacaaaaatctcagaaatatcactttattataaacttttaccttagacttgtaaaacgagaacataaagtctaaaataaggagtatgattacaatagataaaattttagaaattttaaaaaatgaccataatttcagagagattttgtttcatgagcattattattataactggacacaaaatgtaacttttaatgccttatcatatgatagtcgtcaaatttcatctgatactttatttttcgctaagggtgctacttttaaaaaagaatatctagattctgcaatcacagcaggcctttctttttacgtttctgagacagattacggcgccgatattccagtgatattagtcaatgatatcaaaaaagccatgagtttgatatctatgtctttctataataacccacaaaacaaacttaaacttctagcttttactggaacaaaaggaaaaacaactgcggcttactttgcttatcatatgttaaaagtaaaccatcgtcctgctatgctctcaactatgaacacaacattagatggtaaatctttctttaaatcacatctcacaacccccgagagtcttgatttatttcggatgatggctacagccgttgagaatcaaatgacacacttaattatggaagtatcaagccaagcatacctaaccaaacgtgtttatggtttaacctttgacgttggcgttttcttaaatattagtcccgatcatattggtcctatcgagcaccctacattcgaagattattttttccacaaacggctcttgatggagaatagcaatgctgttgttgtaaatagtcagatggatcattttaatattgtcaaagaacaggtcgaatatattcctcatgatttctatggagattattctgaaaatgttatcacagaatcaaaggccttttctttccatgtcaaaggaaagttggagaacacctacgatatcaagctgattggaaaattcaatcaagaaaatgctatcgcagctggacttgcttgtctccgacttggtgtttcaattgaagatataaaaaacggaattgcacaaactaccgtccctggccgcatggaagtcctaacacaaaccaacggcgcaaagattttcgttgactatgcccacaacggagacagtttgaagaaattattagctgttgttgaggaacaccaaaaaggggatattatattagtactcggagctcctggtaataaaggtcaaagccgtcgtaaagactttggagatgtcattaatcaacatcctaatctacaagtgatactcactgcagatgatcctaattttgaagatcccttagttatctcacaagaaatagcaagccatattaatcgtccggttactatcatcattgatcgagaagaagcaattgctaatgccagtactcttactaattgcaaactagatgcaattattatcgctggtaaaggagcagatgcttatcaaattatcaaaggaaatcgtgacaattactctggagatttagaagttgcgaaaaaataccttaaacgataaaaaaagctaaacaataatgattattgatactattttgaatcattccaaataattatcattttgttcacatttttcttaattaatgctaaaaaaggcttttgtaagtcttttttctatgttataatgaacttaattttttgctagaaaggttctctatgtctcacataaaagcagaaaacattatcgtatcttacgatcagaaagaaatcatcaataatctttccctcagtatacttaaccaaaaaataacaacgattattggtgccaatggatgtggaaagtctactcttttgaaggctctcacacgcatccataaaataaaagatggtactatcactattgatggtcatgatattgcacatttacccacaaaggaaattgctaagaagattgcacttctcccacaggtgttagaagcaactgaagggataacagtttatgaactaatatcttatggacggttcccacaccaaaaataccttggcaatttgacaaatgacgatcgcagtaaaatccattgggcgatggaaatgactaacgtagcgcaatttgctaatagagatgttgatgacctttcaggaggtcagaggcaaaaagtatggattgctatggctttagcacaagatacagatactatctttttagacgaacctacaacttatcttgacatgaatcatcaattagaagtcttagaattgctcaaaaaacttaatgacgaaacgcaaaaaacaattattatggtcctacacgacctaaacctgtctgcgcgctattctgattatctagttgcaatgaaaaccggtaaaattatctatgaaggtagtcctagtcagatcatgactaaagatattatcaaagatatttttaagattgatgctcatatcattcaggaccctattagtaaacaacctgttttgttatcttatcaattatcaactgatcaaaattaatattatttaggagatgttatcttatgaaaaaaattggaattattgtcctcacactactgaccttctttttggtatcttgcggacaacaaactaaacaagaaagcactaaaacaactatttctaaaatgcctaaaattgaaggcttcacctattatggaaaaattcctgaaaatccgaaaaaagtaattaattttacatattcttacactgggtatttattaaaactaggtgttaatgtttcaagttacagtttagacttagaaaaagatagccccgtttttggtaaacaactgaaagaagctaaaaaattaactgctgatgatacagaagctattgccgcacaaaaacctgatttaatcatggttttcgatcaagatccaaacatcaatactctgaaaaaaattgcaccaactttagttattaaatatggtgcacaaaattatttagatatgatgccagccttggggaaagtattcggtaaagaaaaagaagctaatcagtgggttagccaatggaaaactaaaactctcgctgtcaaaaaagatttacaccatatcttaaagcctaacactacttttactattatggatttttatgataaaaatatctatttatatggtaataattttggacgcggtggagaactaatctatgattcactaggttatgctgccccagaaaaagtcaaaaaagatgtctttaaaaaagggtggtttaccgtttcgcaagaagcaatcggtgattacgttggagattatgcccttgttaatataaacaaaacgactaaaaaagcagcttcatcacttaaagaaagtgatgtctggaagaatttaccagctgtcaaaaaagggcacatcatagaaagtaactacgacgtgttttatttctctgaccctctatctttagaagctcaattaaaatcatttacaaaggctatcaaagaaaatacaaattaaaagaaagctcctcttatgtttaaagcttcaaaaaaactcgttcaaaaaaataagtcaaatcatttttggcttgtttttttcataacacttatactatttcttattggttgttacgccagcttacgatttggtgctatcaatttcaagactagtgatttaataactgttttaaaaaatcccttaaaaaactctaatgctcaggatgttatttttgacattagactaccacgcataattgcagctatcttagtaggtgcagctatgtcacaagcaggtgctattatgcagggagtcactcgaaacgccattgctgatcctggactactaggtattaacgccggagctgggttagcccttgttgtagcatatgcttttttagggagcatgcactatagtacgattctcatagtctgcttactagggtctgtcatttcttgtcttttagtcttcacactctcttatacaaagcaaaagggttaccaccaactacgactcattttagccggagcgatgatctccacactttttacgtctgttggacaagtggttacattatactttaaactcaatcgaactgttatcggttggcaagcaggtggtttatcccaaattaactggaaaatgctaatcataatagcacctatcattattttaggtttacttatttcacaactcctagcacatcaattaactatcttgagccttaatgaatctgtggccaaagcattgggacaaaaaactcaattaatgactgcgtttctattacttattgttttgtttttatcagcttcatcagtcgctttgataggaaccgtttctttcattggattgattattccacattttattaagctttttattcccaaagattatcgtctgttattacctttaataggattttcaggggctactttcatgatctgggtagacttatcatctcgtattataaatcccccttcagagacatcaattagttctataatcagtatcgtagggcttccatgtttcctatggttaattagaaaagggaaaaatctatgattcaaaaaaataaagctccttttgttttaatatcatctgtcattatcctactattattaatactagtatcaatttcacttggctatgctaatacttccgttattgacgttttaaaactaataagtggaaaatctgatgatgccttcctttttatcattactaacattcgtttacctcgtattattgtctgtatctttgggggagcttctttaggaattgctgggttgctattacagacgttaaccaaaaatccactagctgattccggtattcttggtatcaatgctggagctggattagtaatcgctctaaccataggaacatttaatgttagcaatccaactatattatactttttacccctatttgctatgtttggagggttggtaactatttttcttatctatcttatgtcatacagaagaaatcacaatattagccctacacgattaatcgtcactggtatcggaatatctacaattatttcaggcgttatgattttgattattagtcagtctaataatcaaaaaatggatatgatcgttgaatggcttagtggaaaaattacaattagttcctggactaccattatcacttttatcccgattctcattttgttatggggattagcatatagtcgcagtcgccaccttaatattatgaacctaaacgagcagactgctctcgctctaggacttcatttaaaaaaggaaagaatatatactttgatgctgacaagtagcctcgctgctattagcgtcgtcttaattggtaatattacttttataggcttactcgctgggcacttaagtagacgactattaggaaataaccataaaattatactacctagctgtcttcttattggtgctattatcctattggtatcagatactataggtcgtctcctcttagttggtacgggtattcccactggattggttgtatcaataattggtgccccctattttctctggttgatgacaaaagttgactaaaaaagactggacaaacttccagtcttttttatgttaagtaaatctttaaagcttcaacatcaagtttagcatttaaacgataggtagtatcttggtttaagctaatatatccaagtaattctaaagcttggataaaaataactgtacgtttttgcttaacactatccttgcgaagaaatttcaatataaagcttgacatatattttaaagcatattccgaattaacatctcctaaaagttgataaagctttttttgttctcttgaaagtggataaccgttagttagtttatagaaataattagaaagagtcaaagtgtttctttcaaaatctgtctcttctacaaataccaagtgattggttgggttatctaaatttgtcacaaattttcgcttctgtaataactgatagatttgactatcagaatctatgaaaaccaaatcatctaatactaatccatctagcgaactcagaaaaggaagattaaggctgtagcgtttattttggcgaaggatatatccatgattaatatattcttctaacaaacggtcaattttagaatagtctgtaaagtgggactttatttttcttagtgttacatcatcatgtatccaaagatagttaataagctccttaaaaaactcttgtctttctaactttcctggattaaacgttaatatcataaaagcgctcctaaatgtatgactaaaaaaacgggacgcagcccgttttacatgattaattaagcattgtagctttctgtcaattgaggaacaacttgttttttgcgtgatactgccccagcaagaaaagcgtggttattttcaagtgtaaattcaaaagctgcttcaactttagccatatttgaaccgagagctaaaatctctgaatttgaattaacaatgtcagtaatcatcaatacaaaatcagaataaccttctgtgacaattgcttcttgaatagcaacttcaatctcttcttgacgtgctaaaatatcgttaatgtccacagtattaacttgtgcaacacgaacagcttctccatttaattcaaatgttttagcatcaatatcaatcaactccgctgcagtcttacttgagaggttagtacctgctttaagcatttctaaaccatattcttctaagtttacacctgcaagctctgctagttcttttgcaactggaatatctgaagcatgagttgttggtgatttcaaaagaagagtatctgaaatcaaacctgataataataaaccagccaactctttgggtactgatactccattttccttaaacatacggtaaacaatcgatgatgctgagccaactggttccaaacgcatatataacggattggcagtctcaaagttagcaacacgatgatgatcaacaacaccataaactgtcacatctttaatatcagaaatagattgttggaattcgttatggtcagttaaaatgactgtctctacaccctctgcttttgcagattctactactcgaggtgcttgaacaccaaaataatctaaaacatatgctgtttcttcatttggagttcctaaagcaacggcctctgtgtcaagcccccaagcttctttagctagatatgcaaaagcaactgatgatccaatagcatctgaatctggattttggtgaccaaagactaaaattttagacatgtttttacctcttcttttatattcaccttattgtagcaaaaattgaataacttagcaaaaaatcttactaggaagccctttgcaactaaaaaagttgaataaaattcaacttaaaactaattttgaatcctttttagatattctgtataggattctgttttcatgatatctttagcgtttttaacacgttctggagttggtggtttcacaccagctaatggatacggaattcctaattcacgccatttgaactctcccatagtatgataaggcaatacttcaaatttatcgacattatcaagtgtttggacaaattcacccaaacgttttaaatggtcatcaatatcagtcaatccaggaactaaaacatgacgaatccataccggagtacctctatcagataaatatctagcaaactgtaaaatatttttgttagactgacgagttacaattttatgttgttctgaatcaatttcttttaagtcaaggagtaccaaatcagtaacatctaacaatttttcaaggatagcatggtattctggtgttgctcgataagcaaaaccacaagtatctagcgtcgtatgaatacctagtttcttagcctcaataaagagggctgtaataaagtcaatttgcagcattgcttcaccacctgaaactgtgatacctccatcttttccccaaaaatgtttataacggagagcttcctttagaacatcctcaacggtacgttcctttgaattgttagtttccatttcccaagtatcaggattatgacagtattgacaacgcattttacatccttgcataaaaatgataaaacgaatacctggcccatccacagagccgaaactttctgtagaatggatcattcctgttacttttttatagtctatttctgccatttcatcaccttgtaaccgtttttatgactttattatatcattttcatgaaaaaaagactaagtaatcttagtctttttcaatattctgttctatatcagacaatagcaccttcaattttgttatacgaccatctttaactttatcattaatcaaagtgatgtgtttatctttgctgtctacttcgtaagctactttttcctcttggtttggaatactacccacaccagttaaataataacccgcaattgtatcaacatcatcactttctaactctgtctcaaaataatcattaaattcattaagcgtcatagttcctagaacaatatagatattctcatcgatttccctgacaaattgttcagctgtatctgtttcatcatcaatttcgccgacaatttcttccaataaatcctctagagttactaaaccagcaacgccaccatattcatctagtaaaatggccatttgattttgagtgttgcgtaatgcttttaaaaggtcatctacaaaaatcgtttctggaacaaaaagaggttcctgaagtatttttcgcaagtcgatagtatcaaaaccagttttaaagcccgcttccaataagcgcttggtatgtaaaacaccaacaactctatctttatcgtcatcaaaaacagggacacgagaaaagttttgtgataaaattccttcaatatttgattgtgcatcattgttgatgtcaatcatgaaagcatcagtgcgcggaaccataacttcacgcgccatcatttcatctagcgagaaaatcccttgcagcatctcaatttcttcagcttccaaagtttcttcactattcgtcaacatatattcaatttcatcacgtgtcatcttctcgtcagcatcatcaaaagtcatcggagtgattctactcaataagttagttgaagctgagagcaaccatacaaaggggcttacgattttccctagaaagataataatgggagctgaaacaattgctagacgatctttcaaattcatagcaatacgcttaggatataattctcctagaacaatagagacatatgttaaaaagattagcgcaataatactccctgctgtacgggctgttgctgaatttcctagccaccctgaaatcacatgtcctagtgaggcagataaactagccccttgcaaaaggctaataaaagtaataccaacttgaattgttgataaaaaattattgggattttcaagaacgtccaaaagacgtcgataccttttgtccccttcttcagctttctgttctactttagagcggtttagcgatactaaagccatttcagatgctgaaaagaaggcgttaaatagggttaatattaataaaataacaaattgtagtaacaaactctgactgccagggtcttgcatggaaaattactcctaaataaaaattatttgaatttagctgatagcgattaactctaccaactgttcttctattagataatgctatcattatatcatataatagcactgagcgcatagtcgataatattgtttatggcattttatagaaattatcattttagctaattgcctaaagatagttacacctcattttcatatgattgtaacttttctaccataattaaaaagggaggcgtattaacttgattgagtggttgataaagcattgtagcgaaattattctgtggtaattgttccacgaatgctatcaccgcatctttctcactttttccaccatcatgaccataataaaccataagtgatagacgtccacctacttctaaaatgtctaaaacgtttttgattgccttgatagttgtgtgtggttttgtaataactgttttatccgctgagggtaagtatcccagattaaatatagccgctcttaaaggtgtatgaacatattgttccaaattttcatgcccatccaagataagttcagcgttagagatcccttgctccgtgagctttgctttcgtttttgctattgcttcttcttgaatatcaaatgcataaacttttttagaacttttcgctaaaaaaacagtatcattcccatttcccatagttgcatcaagcgttattgcttctttatcaataacttctgctaaaaaatcatgagaaagatgaattggtcttttaatcatgttttacctcagctttacatccttgatatgactgtcttttctccatttctttgtcaatggcattaagcacttcccatttattaaggctccacatcggtccaattaacatatgacgtggcgcatcaccagtaattcggtgaataacaatatgttttggaataatctccagttggtcacaaataatcgaaatatagtcttcttgacttaacaaacgtaaacgaccttcatggtaatctctctgcattcttgtattagtcataagatgcagaaggtgtaattttataccctgaatatcattatccgtaacacatcgacgaacattttccaccatcatatcatgtgtctcccctggaaggccatttattaggtgagaaacgatttctactttaggagctaattctcgtattctcttaacagtttttttgtaaaggtcatatgaatgtgctctatttattaatgcagaagttgcttcataagttgtctgaaggcctaattctaaagtcacatgcattctttcagaaagttcagcgagatagtatatagtttcatcaggtaagcaatccggccttgttccgatgttgattccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacgtcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaagtaccttggcacaacagtttccatatactcttaggcatatagtactgcaataaaataataatactcccaaatatcataaatgttcccatcgagtgcccactgggaaacgaatagccacctgcaaatactaaatgggttaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatagtttggtcaaatgaaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacggtcaagctaactgtaccaaatagactagctttaataaaatcttttgcactctctctatttttccagaaaatagcgaaacttgctaaaaataaagctagagcaaccatattcatcggtaaaccaataaacgtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtatgtacgcgaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatactgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactccggatagccttttctttatctttccttcttttgtatatttaataagttttaatcggcctgtttcaacttttcgcttaggatttatctgtaattgatttgataacttatcatctggtaattcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctctttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaggaggttccttcaaggtgtcctgctcctttttcaagaacactactggtagtccccgcatagataggtaatttttgcttgatagacggtatatcaatatatccaatcatttcagcaatctcaagcatgtgggcgtattcagcaataccttttttttctttttcagtatagggatctgataggcggcttgggtccagtgttctattataagcttttgctaactcaaatcgtctattaatctctttagtatttaatttttgggtttgattatcaaagttagttacttgattattagctttaatattatagtaccaatttgaaataaaaggatatgaggttatcaaaagaccaactaagaacaatagtatcaagcctacattcatccatcgatttaaaacgaccgatttcttaaggtttttctgaaattttcctcccattatgattcaattccttttctaacacttgctaaacgatttttttgacgttgacgttttattaaccaaagtaaccaagcaataataactaaagatatatagaatagatatctataaatcgtgtttaaatgaccgtcttttattaatttttcatcaataggacctttataagggatacgatgtccccttactaaaagtctgtgtgtattgatcataatcggggtgcaagtcaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagttctttatctggaattcctgaatgcgctgttataacagtatgtgtactattgcccccaattggaagagaggtaccttctaaatgccctgctcctttagatagaacttcttgacttgaacctgcaaatatagggagtttttgacctatcttaggaactgaaattgttccgattttttcacttacctctaacatacgggcgtactctgctacccccttttgaattcgttttttctcataaggatcttcaagatggacattatttaaagaatcattataagcttgtgctagagccatacgtcgattgatttctttctgactaagttttttagcagctctctcaaaatcctgtgtttgattattagattctatcgtatagtaaaaacgtgataccactggatacaataaaatagatagacctattagaaaaagaatgataaaaggaagatttgacttcttctttttttttgtttttttgatgatttttttagtcttcacgtcatctcctagataatggctcttgcttatgatctaagagtacttctactgaaatacccttagatcataagcacagctttaactgcgcttatacatcatcaaagactagccttaagcttcctttgattggcgtcttttcatgataactactgctccaagcataatgcttaaaccaataattgtgaaaagaattgtaccaataccacctgtttgtgggattgttacctttttattttctacacgtgtcgcatctttttggttgctgttagcaacgtagtcaatgttaccacctgttatgtatgacccttgattaactacaaacttaatattacctgccaacttagcaaatcctgctggagcaagtgtttcttcaaggttgtaagtaccgtctgcaagacctgtaacttcaaattgaccttgatcgtttgaagtgtaggtaatggctctagccttatctgttatccactcataagctgtacgagcctcaatgaaggctgcatcgtaatctgcttgtttagttttgataagttcttttgcagtaattcctttttcacctttttggtctgttgcagacaacttgttataagcagcgatagcttcatctaaagctattttcttagcagctaaagttttttgaccttctgattgatctgctttaagagcaaggtatttacctgctgagtttttcacaacgaattgtgcaccagccaaacggtcaccttgttcattagttttgacaaatttcttaccatgagtttcaacttttggttcagttgggttcaatggtgttgggttatcagaatctttggtattggtaatggttactttaccattttctagatttattgcacttccgtaaccagaaacacgttctgagatcatgtatgatttgttttctagaccagtgaatttacccgagaagttaccagatacttcaaatttgataccatttccaaggtcgattgtacctttagatgtttttgtcaatgatactgaagcaacagttttatctttatctttcaatgtgtaaacaacgtttacaccatcaggtgcaattccgtcagaccaagttttagcaactgttacttcaccctttgaaggtgtaacaggaagttcagtcaagtctttacctggtttgttaccatacgacaatttgatatcattggattctggattatcaataattgcttgaccattaacagtagcactataagtcaatgtaaattcaatatcagctgttttagctgctttttccaatttgcccaatccatcagctgtgaattttaatgtgaaaccacgggcatcaatgctaagttcatagtctgtatccttagcaaaagtttctgtagttcctgaagctttaaggctaacagttgaacccattgtcaaaccatttgacattatatctgtccaaaccaagttttcgtatttagaacctttgtgaatttttgttttaacttcataaggaacaactttaccgatttcagcagtagcagttgctttgtcacgtgcataattaccataatttgcgccagctgtcaaaagtctattaacatctgtcaatgctgtcaaatcgtttgttttagcaaagtttttatcaatttctggtttttcttcagtgttctttggataaacatgggcatcagcaacaacaccatcttcatttaccaatggaagagtgatgttaactggaaccgcttttgaagcagccaggagggaaccattattgttgtaagtagattttgatttaacttcaacaattttaaactcgcctttcaatcctttggtgttgaaaacaagtccagtatctccctctggtgtcaatccagacacggcctcatcaatatttactgttatttcaggagtaccatctttattaattaaggctggtgttaatttgttaccttcttttgccttaacatattgcactttaccacttttatcttctttcaaagctaaagcaaagaacgcaccttcgatttctttagatccctcgccaaagtaaccagcaaggtcagaaatagctccacctttgtagtcttttccgttaagacctgtagttcctgggaagttacttttgttaagatttgattcggtttgcaaaatcttgtgcaaagtcactgtattagttgttgcttcatccgcaaacgctggtgcaactgagagcaatgacgttaaagtcagtaacaatgccgagaacattgcaaaatatttgttgattcttttcatttctatctccttcttattttagttaatcaacatgattaataatatgcggattttaatacaccgcagcaccactcccttcaagtcatggaattttagttaattaattaagaatactaaagcgcataatttttaatcttttttgatggacatatcactagatttcttataccttttccaaatataaattccacctgcaatagacatcatagctccacctattaaaatgaaagatagaattcctttcccacctgtcataggaataattccttttggtggaatatgcgtgttggtaattaaatgcttgtcaccttcctcatgatattcagaaatctgtttattaacagctattatattttttatcgatcctttaaccacttcaaaagttaaaattggtttattagtaattttttgataatcctccggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgagaagcaacttattattatctttatcaacttttataaattcaatttcacctaacttcttctcgtttttaatcgttattgtaggatattctctcacatcacgaattttagggattggaaaatctctaagtgtattaggatcctctgacttaggattcaatgttgttctaccattagtgtcatagaatttgttacttataaaactgtcatctagtttcacatcatatgtgagtgttactttttgaccttctcctaaattcaaacctctaacatagagtttatttccgatgtattctaatttaacccccttaagtattccaccatcattattaggcccaccagttgcaataccatccttcattacacttccatcatttccctgtaaagtataatcacttggctgtaatgtttgtccattaccaagctgtaaattgattttatcacccataggatcttcgatagttccattaacaattgagttttcttttgttaaaatcgtttcaaattgttgctgaattttagataaaatttcattgttagatgtatcggctgaagttacgataggggtgtagtactcaggtttggaagagaacgacctcattagttctgtgatttctccatctgaaagtttaaaagcttcctctttcaatttttgaaaagtaccatcttgatttttcttatactcctcattataaacttgtctaaaaccagatatatcgataccaaaattaaaaatgtcataatttttctgttttaaactatttatataaagtttggttggtgttccatgttctttcactggtccatttcgataaattgtacctttagggtaattaagatttaaatctaaataatgaagtttttgtaagtttccagagattatctgtgtttgataactatctaagggaaacaaaaagtaactctccccatttccttttatatcctcgggcttatcagtaagtagaaaattacttttatttagatatccattttttttcatttgttcaaattggctttcatatgatgcacccagtttaaaattattaatagcatatgatctcgtaggaacaccatcagttacatgaacaataattttttgactatttcgatttacttgactcaaaatatcatctgcctccatgaaggctttcatagtaaatgtttctcctactttactaagatagtactccttttgttgctctggagttaatccattggtagtagatccccacttagctttaggagcttctgtcggaatcctttttataatctcttcagcattatttgttaattgtttatgactataattctctgtctgaattgtgaacttagtttgaaggccataatatttatcatcttctttaaatccttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcctgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaatgttttttcccaatttttgaataatttttctttttatttgataatcttattttttattatcttagaaatatttcaatgagcttaagtagttgatttttctttttttatgttttaaaatattgcttaaaaataatgtttgagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatctttttttccgaacatttattttaggattaaatcaattaatccctgaaacaatttcatttccttcatggaactatcatagacatgataaattaactactattctccgaccgataattacaaattggttaagtaaaattggagaatacacgtttaaagaacaacattttcttctcctttgtactcatctagaaagaatcatcaaaaatcatattcctccgatacagatagccgtactaactacagactttattaataaccaaattttaacagaatgcttattacagagattttcttctaaaaagattcatttccacccttactatttattaactgatgatctttccaatattactaatcttaatccagacattattattaccaataaaaagctttctccctttatcaaacatgagatttcttcagagagtttaattacatatattgatctgattaatacttcagaccaaatcaatcaaatccaaaaaattatttcatcaatacaggaagaaaaatattgcaaactttttgcaaaaactaatgaaataactaatcgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtaccagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgattctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaatccctttattttctgttaaataatcaacagttaggtgcccctcttcattataatcggctactaattgagaaatttcttccttatttttcgagccattatctacgatatagatgtggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaagactcaacagccattagcggaccgacagcttcataccctttcccaaaaaagaagacggcaaatgtcgacgaaactcctaccactcccgcaatcattaacattgagatagcattgcttaaatcaacaagtttcaaaagtaaagccttagcttgcttttcttttcctgaagaaaatagactggagagccttggtaagaaaactcctccgattgctgaaacaatggtaaataaaatacgaataattttatcagattgatcaaaatatccagcactgaccacactatccattgctcccagcatactcttgttaagagagagataaatctgcatggtgatttggggtaaaaataacattaaagttggtcttagatgtattaagatatctaatctactaaatggtatcttgatgatttcatgctttaaatgatgccagactgttaaatttccgagtaatgatgcaaatgcaattaaaaacatataaagtgctaggtcatctggcgtcttcacaactaagaaggtcaaaacaactgtaataagcttaacaatggtattacgaatgacaattatcttaaagtcttcaactccaataaaataccacgaaatatcagttgcagtcgctaataaattaataccttgaattaaatagaataattgccattcgtttgtaagtaagacaaatccaaagaataataacgttgctatagatacagaggcaagttttaatacaactaattcccaaaatatcttacttctcttatacttatttgactgcacaaaagctatctcacgattaccgtacaaagatatccctaaagcaccaaataaagtaaagtacatgacaatggagctcgtataggcattaataccgatgccttgaggagatagtacacgggaaacataaggaactgttactaaaggtaacaacaaagtcaataactggtatgaggtattataaaacatatttttcaaaagtttcattagtttctcctcataattaaactaataacagtatcaaataacaataaggcatttgatacaattaccaagccagttaacgcatacggcaccactttccttcctgcctcatttagacgcgctggaatacttgatgcaaaaacttgtaccaaaagcaatgtaacagtaaagtaacgtccttgaactccttcaatgtagcttgttggcgctccacgatattctaacatgataaaaaagacaccaagaattcccacaaagaaactagctaagaaaagaaatcccatattttttgacttaacaaatttttcttcagaaaaccatactagaaagaccatgagataccatactgatgatacccaagtgggaataaaattctgacttggatatggagaggcaagccaggaagtaatgtcattacttaaaatattgataccagcataattatagccaaatgtcattacataacgtcttaaaacagcaaggacaccaccatgtcttgcggtcagaacataaactatagcaagtgacaaaaaggttagacatagccaaaatagctttttagatttaagaccttgaaataaatgtgatagcttctgattatagcccattaatttaggattgttaacctgcaataataccggtattactagcaataaaaacagccagtaattctgcttacatgcaacaatgactaaaagaatcaatcctataagagcaatactaagatttttagtcaacgatttatcaactaaaagatttatcaaaagcgataaaaatgctccaaatacaatatatccagtcgagtcataagatagactagcaaatgaatttagaactacgggactgaggaaaatagcaaagtagattaactttccttttttcacataccggataatgagggcaaccaaggtgattgagacaaaggaactaaataaccttgctactgtaatcattacccccatagaaggatacacaaatttgcctaaaaataagccaactgctggcacaagatgaccccaaaaaacaaagttatgtttagaatagtttatctcacgaggcaaatgattaccatcaacaaaattggctttatttaaatagtatttttcaaatctagtaccatctctataggaggtcgattgtcgtctcatacctgaatcaatattatattctccatagtaagaagtatcaataatgttatttgaaatacgaccagacacagctaaatggtattgtccatcaggttcattgaaaaatggcattaataggctcaatacaatagtaatcgttaagcctaatataaaatatgttttatgcaagttcttgtctagaaaaaacttttcaaatagacgaacttttttgaggttcatattaactcctttttatatcttttaataaaaacaccaagtcacgaatgcgatttgaaaagctatcatagaaccgttttttagtcatcatttgtttaagtattgctacaaaatctttattttgagcatttttataacgttgctgattaaaatccagataagctttagcttcccttaattgactagagctacttttttctaaaaatggtacaaggatgatatagtaactcaaaacaaaatacagttcttgtaaatgcctttcgtaacttgagctcatattcaagatattcccacttgcattctcagcatgtcgcttatgttcaccaacacttctgtttaaattgtaacctgaaccaatgacaccagatacccctgcaaaaagattatcatgtgacaaaattaaattatcactgtaaaaagtcattacttgatcaacaaacgacttgcgtaaacaaaaagtccaaccttgacgatagttatgatatgaaaagtctaatggatacttagaaattgtttcctcaccattgaacttaaaattattgggaatagtagcctcttctgataactttttgatatcaatatcggcgctaagaaggtttatatcttggcgttcttccataatatcaacttgcatcttatttttatgatgataccatgtgtcatcttgatcactaaaaaagacatagtcaacctcataggctaacacatcaataagtaattgacgaaaatttaaacgccaacctaaatttttatcattactagttattgaccaaccatctaaacggtgctcttttatatagtcttcaaccacctttacagtatcatcagtagagccatcgtccctcattaagacatagtctggtctcaacgtttgatttctaattgaatctagctgatcgtggatgaaaccttgaccattatatgttgccatcaaaactgctgtttttaccatattattccttactttttaaacgcaaataataaatctctcatacgtccactattagagttatagagtcgccaatttttaatcacaaaagcactattatgaattaatgacaatttagaagcttccaatctttctttttcaaaggctaagcgttgatttaaagcgacatcattttgatatttgttgacaaccttctgcatggtttcgtaaaaatcaacaaatgtttttaatcctgtgatatgttgtgttttaggcgacttccaattcaaaacaaatttgctattaccacttgcgtttcctccatatcgaatatgaactcctacgctttcgttaaggttataaccatttccaataatactggcagttgtctcgataagattatcgtgcgaaatattagctccaaaagtccaattatcagcgatagcttgcgcaaaatctctcttcatagcaatggtccatccgggacggaatgtttgataatcatatactttaggatactgactgattctatcactagaagaaaaagttagaaaatgtggaacactggcttctgtagacatcgttttgatatcaacgtctgcactcaaaacctcaatttgaggtttatctgacataatggcaaactgtcgttcgtttttatcaagataccaaatatcatcttgatcactaaaaaagacatagtcaacctcataggctaacacatcaataagtaattgacgaaaatttaaacgccagcctaagtttttgtcgtttttaacaattttccagccttctaactcatgttttgcgatatagttattgacgacattgactgtttcatccgttgaacaatcatccctcaataatacataatctggttttaatgtctgttggcgaattgaatcaagttgttcagatataaatatttcgccattgtatgtcgccattaaaactgctgtctttaccatattactcctcaaatgcttgtactgtttttaatattccagattcaagagaaacttctcgcttccatcccaacgcttctaatttggccatagtgagacgtgttctccccattttgctataacctgcactcatagttttaggaatatcgaatactactgaaatatttttatcagaaaagagatcaactaacttttgtgccaaatccttaatcataatgggttgatcttcatttgctacattgtaagcttgaccaacttcaccatttaataaaatagtaaataaccctgatacagcatctgctaaataacagaaagcacgctctgctgtaccactactttttaaaacgatatctttgccatcaatgacattcgataaaagatcattcataatacgaccatcgttaccaagctccataccaggaccaaatgaatgtgcaatacgagcaatagtaaagggtaccttatattgatcatagtaactttgcagtagagtttcagccatacgtttgctttctgggtaacaagctctagtagctaaaatatcaaatccaccataagcttcttcatcaatcacttctttaatagatgttccatatacttcacgcgttgataagaacaagaagttttcaattgttttttcctttgcaaagtctaataaattcaatgtaccaattgtattagcttttatgatgctaacaggattactcaaaatagcagttggactagcattgcttgctgcatggataatgtaatccacttttccatcatactctaggcgttcttctacatcataaggaattaaggtgaaataatctttcccaactaaatctgaaaatttatcacgggctttttcaatgtttctagctgtcgcaataatttgcgtttggtaatttcttgtctcattgagataggctagtaaaaataccatataactcgctaacatactattagaaccacttattaaaacgcctttattagcaattctttcccaattaatataattttggttactaataagtgctaaatcttcttgtacaattttattactaaatttaatcatcattacatcccataaatttgttcattttctctagcatcatacaaagctttaaacatataaaaatcatctggtgttgttatcttgatattttcatatggtccctcaacaatagtgagttcacgattgtacatacccatcaaagtactagaatcaattgcatcagtaatccctttgctaatggcatcacgttcaacagaaaggatatctgatagataaaaactttgtggcgctttagcaatgaaggaacgagtacgatcaacaacttcagatattttagaagaatcattgactagaacaactgtctctttagcacgaactgaagttaccgcacttcctgtttcttttactgactgtatattagcattaataacttcttcattaatcaatggacgtactccgtcatgaattaaaacaacggcatcatctgtagccagctgttcagcggcttcaagccccttaaaaattgacatttggccagtttctccacctgcaacaactgcttttactttcgtaaggttgaaacgctctaccagattattcatataatctagccagtctgatacacagacaactactacagcatcaatagcttctgtattttggaaaatatcaattgtgtgtacaataatgggtttaccatgcacttctaggaattgctttggtttacctttggtattcatgcgacgaccaacaccacctgcaaaaataactccaatattcatcattaaccttctttccagtaccaagtgtaataactatgactttctctcttactttctggaggtaattccatataactacccccatataattgattcagataagcatgctcatttttaatttttcgggttttaatgttttcaaacataacatcttcatactcagaaaaaatttctcttggaaaatattctttcaagcgatatcttgaatcggtataacccatgtaaggaacctcttgattattatatgtttccatcacttgatcaacaatttcagcacgttttttagcttggccgtgataagcgatgaatcggggtagccccaaaattagccttgcatttgcataaagctttcgggaaccgctagcaaaattggggtaagtcgtacacatcaaatttgcagcagcagagtgaacttttttaaagaatctttgacgttcttctgcactctctggtaatcggtcaagtgggaagatatcaataaaaatccctgtccaaggatgaattctatctgttttacttaagtacattgactttgtgtgatacagcttggcaaatggccatagatttttttcaacagaatgatgtagcaatttaaaatcgctattattagcatcagctaatgctttcatcaaacgctcatactggcttctttctagcatcaaatcaatatcgtcatcccatggaatgaatcctttatgtctcattgctcccagtaggctgcctccgcctaaagaatattcaattttattatcacgcgcaactttatcaatataagctaacatttcaagttgaacttctcttatttctgagaccgtcatttctttcataattacctctgtctaacagttaactcacattcttttaaatacaaatcttatagctgtaatatagaaaataaataaagctactgcaaaaagaatcactagggtcatgggtttgaaagttttctttgttttttgaccttttggagtgtttgcaagtgcattgtattcttgtttgttgtactgcatgtccattatataaccatttatattatagttaccaaattgtgctttagaaacactatctttatttactgtaaaataaaatggtttattgctttgtaagtagccttttggagattttgtctgtattaagaaatacttatatttattagacaaacctcgtaatttaaataatgattggttacttttcacttgttttttatagttataagcccataacctaggattcaagtctatgtcatttgaatagccatcaatacctataatgttatttcctctaatatggtaagcattttggttaagatattctttatttaaactcttaatcgttttttgagtatttatccaaaagccattaggttgatatagagatacttttttatctgcattcaatcttcctaaaatatactctgaaccttgtaataatctattttgattgtcgtcatacatggcaaaatttataccataactgctcaaactaggtgtctttatatagcctttagaatcctcgacaaaaatcccttgatcttgtttttgattatcaacagaaattagactccgtttagtctctatgacgcctttcttttcctgagcaacagacaaattataatctctttttgaagcaacatgtcctgtaatctctaactctttaatatcagcatttgtcaaatcaaagtctaacttatcaatagagtgaagtttatacaggctattttgtaataattctttttgctctgtttcatcaccactactatttaaaacaattttatcaccatcgacactaatactgctatctattggatacaaacgtccctctttaccttcttccgcaataataggcgcttgagaaagtcggtaattataattagtactatctactacaaaattagggctaactctgacagtcagctgctttgaataaattggaatcctataagtaatacgtttaccgtattcaactcctatagtatctctttttttgttattaacagttactcgaggattatctactcgggtattaccaagataaatcgtttcgtttttctgaatatttttcaacacatattcttgagtttctgcgctgttttcaaaagcagttaaaccaactggaatattaccaattgcttttcctttgttatttgtgaacttataacgtttattttctggattatataaaacacttggctcttctaagccattcatgtaaattaaataatctttattcttttcaagcagtaaccttacaatagcaatagcatcctgtctagtattttttataccagaaccaaatctatagttattatccataaggacttttttaccactaacttggtacttccgcttgatactatcaaaagtatagtgtgtaaagtctttgctctcaaactcccccgtcctcactttatccaatgctgtttgtaaatgaatagcattaatctgaacactgtattgcggggtattattatgataataataagctgtaatatctacttttttatctgtttttacttttttattattttggcaacctactaaaaaaagcatgaaaaacagacaaataaaaatatgttttttactcatctaaagtgctatcctctatctcttttttcaacaaagaaacctcttgaatcaggcgtttaatttgctcatctcttttggtattgctactagtatcaaataattctaaacaaaacagaaataaaatagcaccaaataacaagaaattcatcgttaaagcgaatccaaggtgatgagcgataaatgagaccaccccaggaaatacactaataaagactagaattaaaccaactaatagccaaggtaaagaacgtttaacagaaaatgtgtttttattaaccattcttataatcatataaagtaggacaatggctaaaataaacatttcaatttgcaatgctaaactcatttatcatcctccttaataaaccctgcaataataattgatgttaaaacatccgtcatataaaaaatcgattttagggaacttatacttgaagtacctgcctcacgttcaaacatattagctgtgacttccttcaaacgatagccttttttcaaaatccgagcagttgattcaggctctgggtattgtactggataatgacacgataaataagctattagcgccgcgttggctgccctataaccacttgttgtatcatagactttgtgtcccgtcgttaattttatagcagcagatattaaatttatgccaagacgcctcattgctgtcgattgaaaattttgatgttttttatcaacaaagcgagaaccaataacaaaatctgcttcgtcatttaagattggcataacaacatcttcaatgcttctaatatcatgttgaccatcaccatcaaattgaacggcaacatcgtaatgattacgattagcgtataagtatcctgtctgcacacagccaccaatacctagattttgaacaaggtcaatatgatttaaacccaatctatctaataactctggagtaccatcggttgacccatcgttaataacaatataatccagctcaaaaggtagtgagcgagacgccttaaaatctacaatagtctggactgtctttgcaatactaccttcttcattataagcaggtatcactagtaaaatttttttcatcatcttatctcttattgtaataatttgttgcaatcaaccatttaaacacaacttgatgcttaaattgatttttgctataaccatatttccataaccaccttaatcttgtcataaaaggctgtttgtcaatttttataaaacatttaatgagctcaagatcattagctgtcataatatcaccatacttatcaacaattaaggaagcttgcttttgtgagtcatggataagtttccaataccttgtaaatatagatttaggaccttcacgaagtatcttaaatctcttatccattgtcctcgcccccaaaacattattgtcatgttgacggtatagttgagttggtaaatccaaataaatgatttctcctaaacttgctgctaagagtgctaaaaaccaatcatgcattaagatatcattaggagtaaaccacttctcagctaatgcatgatttatcatcatagtcccaccagtaacagtattctcagttagttctggtaataatgtcgtattggcatggtgcgattgagcccgaatcatgctgtcttgtaaaatatttaattcttgattaacaactttcaaatcagtataaacaagtaatggtacatcagatgctttatgctttgctgcctctaaacttacagataacttttctggcaaccatacatcatcttgatcactaaaaaaatagaaatctgcaacttcgtaattaactagcgtaaaaaatgatttaataactcctaaattatggtgctcattttcattaatgaaacgaattcgagaatctttagcagtaaagtttctaataatatcacatgtcttgtcacttgaaccatcatctctgattaggaggttccactctttaaaggtttgcttttggatactttcgatttgctgcgccagaaacttctctccattgtaggtggccattaaaatattaactttcatttaaaaacaaatcctcatattcttcaacaatttttttccaagtatagttttcttgaataatggcttttgctcgatcaccgtaagtagataaatcctgttgttgatcactatcgttaataagcttagctaaatccccctcttttttagcccagtaaaaacttgagagacctgctactgatttgttgaaatcaacatctagaacaagattcaaatcagtattagctaaagcctcaagcagtcctggattagtaccgccaacttcatgcccatgaatataagcaaaggcttgttgacgaacataatccagcagatctttttcatagagcgtacctacaaacttaactcttttatcttgttgaaggtttgtctttaaggacaacttttcaaagtaggggttattttgatggttacagataataactaaatcacgcttagtatctgaagccatgaactccctaatagccgtttcataattgttttcagggacaaatcgaccaacgattagatagtaacccttagacttaatattccattttttaaacaactgtttgacacgtggatcatctgacgataatttcctagaattaatctctgtaccgtaagcaatgaaccttgtcttcacattagagtaggtagattgaatgtaattttcaataccaatattatcagaaataattaggtctgcatttttagtcatacatttttcggcgtattttaaataacgctgtgtgggacgagaccactttgatcgcttccactctaaaccatccggattaacatacaataagccaccgactttatgtattttattggcaaaatgccaaataaaggcaccaattgtatttcctaaaatataaaaaataggctcttttaaatcatgtgtcttaaccaagtcaagggcataattaatggccataatatcataagcaatcacacgtgctggccctaattggggaggatttatagtaaaacaatcagcgtcagcaaagttaaaatgagtatgatgttctttatcactaaggcatgcaacatggtattttatgtcgaaacttttttgatgattaatcaattctgaaacaaaagtttcaaaaccaccgtaacgagctggcaaccctctacttcctataatgaaaacatcttgcatcatcttctccattctagctaaacaatccatacaattataccataaattagaaaagttagctaaaaagagcagtaagctaaaaggattctctagccttactactctttgttttgatcttattttttaacttcctgcttgtagaactcttttaaagcatcttgccaagtaggaatcacaaatcctgttgctttcgctttttccaaactcatagttgaatttaaaggacgttttgcttttgctgggaattgactagaatcaacaggcttaacctccacatctgtgtcttttaagatttcaaccgcaaaatcataccatgttgtatcttctttagcatcatttgataaatgatagtaaccaaaatctttttgattttcagctaaataagtcataaactcagccaaagtacgtgtccatgttggtcgtccatgttggtcgttaacaacagttagagttttgtgtgtttttgcaaggttttgcatcgtaaagacaaagtttttaccatagttaccaaatacccacgctgtgcgaatggtatagaattttgaagtatatttttcaactaactcttcacccatacgttttgtacgaccgtactctgttttgggatcaggcagatcatctacttcccattcttgccccactggtttttcaccatcaaacacgtagtccgtcgaaatgtaaacaagtgttgcatcatgtttagcagcagccttagcgacattctctgtaccagtgacattgattgcaaagtctagctcttttccttcatcttctgccgcatcaacagctgtgtaagctgcacaatggtaaactaaagatggcttcacctcttcaaagactttgtccaccatctcggcatttgtaatatccatttcagctacatcaacagcaacatactcttgagttcgttcgtctaaaaggtgacgtaattcactacctaattgcccgtttgcccctgtaattaaaatcattccttgctcctttaaaaataagtttaacttttaattcttcgtttattgtacactaaaaaagggaatatttcatccctttactctttatcttatgaacgaattcccaaagcgatacgagcataacgactcatcttatcaacagaccaggctgggtaccataccaatttcacctcggtttcagttacctctgggactgttttcataacatcatgaatttgatctgtcaataaatctgctaacgggcatcccatagtcgttaaagtcatatcaatttcagttcgaccgttatcttcaaagcgaatctcataaattaacccaaggttaacaatatctattcccaattcaggatcgataaccatctccaaagcttctaggatacgatcttttatttttccaacttcttcttcgctatattgctttacttctgacattataatacctctctgaaaatattaataccgtctttaagataactcctttgcaaatcatttttattagaaactaaacttcctattctaaaaacgattatcgagaagcaatcaatcttccatgaaatctttaagttgcttgctacgactaggatggcgaagttttctaagggctttagcttcaatctgacgaatgcgctcacgagtaacattaaatactttacctacgtcctctaacgtacgcattttaccatcgtcaagaccaaagcgtaaacgaagaacattctcttcacggtcagtaagagtatctaaaacctcatctaattgctcacgaagaacaacacgtgtagtataatctactggattttcaataacttcgtcttcaatgaaatcacccaaatggctatcatcttcctcaccgattggcgtttctagcgataccggctcttgagcaatttttaggatttcacgtactttatctggtgtcatatccatgcgttctgcgatttgctcaggagttggatcttgaccaagttcttgaagaagattacgttgttcacggaccaatttattaatcgtttcaaccatatgaacaggaatacgaatcgtacgtgcttgatctgcaattgcacgtgttatagcttgacgaatccaccatgttgcataagttgaaaatttgaatccctttgaataatcaaatttatcaacagctttcatgagccccatgttaccctcttgaattaaatcaagaaattgcattccacgtccaacataacgttttgcaattgagacaacaagacgaaggtttgcttcagctaaacgttgtttagccattaaatctccctcagcaaccgcaacagccaattctttttcttcttcattcgttaaaagaggaacaacaccaatttccttcaagtacatacgtactgggtcattgactttagcagaattacttcctatgagctcttcatcagtcaattcttcaggttttggcccttctaccacatactttgttgaaggattgccttctttatctgtgattgaaatgccaccgtctgtcaatcgttctaacaaatcatcaatttgatctgcatctaaaacaaaaggaataacaagtttttctgttacctcatcatcaattgcagtaccttgttttttatgattgcgaataaaatccgcaacttgaacattaaaagttgtatttccttttttctctgccataggttcctcattccatatttcttttttgagcaattaaattttctaatgcagccaaggctccttcttcatcaccttgattactagattgtctaattaactggctttgttttcttaaatcacgttctttcaataaacggtcacgtgccttttcgacggcttcaatctctccaatagatacttctacaggtaattgttcctctaaaattatataataagtacgattaactttgtcactttcttgtgataaatcataagacgtgatctcaccactttcttttagcaactcatataaaacttgtatttctgttgtatcaaaataaaaattatccctattacggaattcatttaacaggtagggatgattcaataatcgatgaaacaattgcatttctgttttagtgatagctgataacttacctgtctgtggtaattgcactgtagcacttgtttgtactgaagatgaagcttgctgttgacttctatgatgcaatcgttcgttattaaccgattgttctacttgaaaataatcaaaatctggcaagagttcagccacttttgtaatatatgaattttgtgctgttatcgatggagatttagcaattaatttcgctattttttcaacataagcaatttcagattgtaaattatcggtgttttcaggctttaagtagtggatataaaactctgtattactgatgcgcccattttctaagagttgtttaaaatcttctgctgaatttgcttgtagaaattcatcagggtccattttattaggtatcctaacgatatcaacagtcatatctgatagcagttctaaagacttgtcaattgcgttttgaccagctctatcaccatcataagtcagaacaactttcttagtaaatcttttaaggtgtctaacatgttcattggttaaagcggtccccatagaagcaacaacattctcaattcctgcacgataagctgcaataacatccataaagccttccattaggtaaacttcgtgtgctttattaattacagcacgcgctttatctaaatggtaaagctcgtaagacttattaaaaataggggtggcacgagaatttttatatttagcttgttttctatcaatgtcctcttgagtccaaactcgtcctgaaaacgcaatgacttcaccaatatcattagttaacggaaacataattctattattaaatgaatcgtaaaactgattgctattttctgaataattgaacaaaccagaagacatcaaagttttttcatcaaactcttttgccagacgacgatatagaaaatcctgccctcccggcgataatcctatttgaaaatgtttaattaagtcctctgtcactccgcgctcggcaaggtattgtctagcgcgttcaccatcattagttgtcattaaataggcatggtaaaatcccgaagcaactctatgaatatctaaaagcgactgattagctttaggttttttaggaacttgccccttaaaattagtatctagaggtattcctgaacgttcagctagaacttgtacactatctaaaaaactaatatgttggtaatcttccacaaatttaaagacatcaccagagcgaccacaaccaaaacaatgaaaaaactgcctatcttcgataacattaaaagatggcgttttttctttatgaaatgggcataaaccaagatgattgcgtcctgtttttgtcaaaccgacaacttcaccgatgacatcaacaatgttaacactgttcttgatttcagaaattttttctttatcaattgccaagtcatgacctccacagaaataacccattatagttttacatttgattatatcattttttcttttctgtgtaaattttttcaaaagctttttcaaggatttcttcttcactgatttaatataaaaatttacagataatttgaaacctattacttggatttctcaaaagaaatctgctataatgaacgtgaattaaataatattaaggagcttgttcacatgattaaagaactaaaagaatttttatttaagggtaatgttttagaccttgctgttgctgttattttaggtgcagcttttaatgctatcatcacttcacttgttaaagacgttattacaccgcttatccttaatcctgtattaaaagctgctggcgtttcaaatatcgcacagctttcatggaatggtgttgcttacggtaatttcttaagtgcagttattaatttcttaatcgttggtactactttattcttcatcgttaaagctgctaacaaggttatggctaagaaacctgctgaagaagaaattattgaagttgttgaaccaacacaagagcaattacttgctgaaatccgcgacttactcgctaacaaataataaaagactcggattaccgagtttttttattaacttatagttataatatatgaaaaaacagctcaattctgaactgttttttcatattctatctaattagaattttttacgtttgcgagctgcttctgatttacgtttacgttttacagaaggtttttcgtagaattcacgtttacgtgattcttgaagagtaccagctttagtcacagaacgtttgaaacgacgaagtgcatcgtcaagtgattcgtttttacgtactactgtttttgacatatgtttcacctcctcaagatattgtaacattttcacgttcacttactaggatacccaaataaaagcagattgtcaatatttttatgatactttctctgggttattatttccctatacgtgatttcaatttttccacaaaaaggtatgccgctggacaagtaagagtattttttatcgttaagttattaatttgatagattttcttacgatcagtatgtggaaattcacgacaagctttaggtctgacatcgtatatactacataagttatcatcgcctaaaaacggacaaggcatcgctttaaatactttatctccatcttcatctacttctaaaaataaatcttcaaaagccgataacttcatccggaaatgtttagaaatcctagaaatatcagcttctgtaaatagaggacccaaagttttacaacaattagcacatgctgtacaatcaatttcttgaaaaacctcttgatgtatctgttggactattttatctaagtttttaggagctttcttttttaaacttgctaaaaatttacgatgctcgccttgtttttggagcgccaaatctttatatttttcaatattaattgaaccctgaaccatatattcctctgcctttatgctattattcttagtcaagccatattataacatccaaaaaagcctatgactaggctttttaatattattcaacttgattgccagttaatttagccgcatctgaaatataaactttatatttatcttctttttcaagtctctttatcactttgttaacagtcttcaacatttttccactgtctttaggtaaagctacagccttagcatccccttctcctgttttaagggcaaacttagcaagaacaaggtctggattctgggccaagtaaccttcagctacggttttttctaaatcaacagcttctaccttgcctgattttaactcactaatcgcttctcccatcgctgtcagtgacacgacgtgagaatttttgaatgatttcttagaaactccctcttcgatacttcctttttgtactgctatttttttacctttaaggctttcgattgaagtatattttcctaaatcagacttcctaacaagaaccgcattttctgtagtgtaataaggttttgaaaaatcatagactttagcacgctctttagtatatgataatccagaaatagccatatcagccttacctgtttgtaaacttgataaaacattgtcaaaactcataggagatacctctagtttgacatgaagctcatcagcaatagcttgagctaactcaatatctgcgccgacaactttatctttcccattaacaagcgctttaaactcaaagggagcataatctggactcaccgctaaaactaacttcccttttttctcaactttatcttgtagctgtttgtctgatgaaccacacgccaccaaagtaacgacagataaaagagataaaattcctaatattattttttttgacataaactatcttccttttattatgataggaacaagtataaatcatctttatacataagtcaagtttttttgaataaaaattcagtaaattacaccgataactatgcttgctgttagacgatttttaataacaactataactaattaaaacaatcaccttttaaaagtattccaattcttaaaaaatgctaactatcattaataatcaactaactttcagaaccttgtacagttgctgtctagtaagaaaatgataataattcgatttagtcactctccttgctaaaataataaataaggttgagatgtacatctcaaccttatttattattttctaaaaatcgctttagatatgatataggtcattataattgacaaaagaattgtggtagctaatgctaacagttgaactggcatatgtgataatttaaagagaccaactcctaaacttcccaacaatcccccaataccattcattccaaaggaggaaacgacatcatcaatggcaaaagctttcgcaacgtaatccgttacaaagtaggtgaagagggatgcaaagaatgttacagctaataattgccaagttaagagatacccaactcctgctgtactcgtcacaagaccaacaataatgccattcaataagcttcctgttttctcttcctcaccattccacttagcagccaatgtccacgccaaaccaccacctataatagcaaatatagtatttaaaagtatcataatggcttgtgaattccactcaccaactggacccatattaaatccaaaccaaccaaatgtaataagtatcattcctaaaaagagactatcatttttaaccttattgtgctgatgttcactcttgccaataacatgagctaaaatatacgaagaaagccctgcagataaatgaacgatcattccgcctgaaaaatcaagtactcccatctttgcaaaaacaccctctgaattccaaattaaataagctaagggcgtatacaccaagaaaagccaagaaacaacagctaataaaagtcgcttcgtctgaactctatcaataattgacccaataagcattactactgcgtaaagggcgaaacaaagttgaaataaacaatttacaatttgtttaccatctgcttcttggaattgaaagacagttttaaaatgaccttcaaatgctaaaaaataggcacccatgaaccaagctgttgtcgttagcaaaacagtaagtacaaactgataaataatccttgaagtcaatgattgatgtagcgacccaaagtaatagaatgcaaccccaaaaatcatgagccacatcgataaaatacataatagtaaaaacacaaatagtcctttctttacaaacactcttttatttgttaaactgtattattgttaactggttaagtattttatcttacacatttatttttgtcaaggagaagacatgaaacattatcaaaccataattatcggtgcaggcgctgcaggaatcggttttggttctgccatgcaacgattaggacttacaaattttcttatcattgaaaaagggcacattggagaatcttttttaagatggcccagaacaacacaatttatcacaccttccttcactaccaatggctttggttttccagatctaaacgctgttattccagatacttctcctgctttctcatttgaaaaagaacatctttctggagtggaatatgcacgctacttacaattagttgctgctcattataatctccctatccaaaacgaaacatctgttctatctattgataaacgagatagcctttttgttattaaaacttcaaagggagatttttctgctgattatcttattatggcaacaggagaatttcaaaatccaaataccattgatattaaaggtgcagatctaggaatgcactatggtcaagttgataatttccatatcaaatctgacaatccatttatcatcattggtggaaacgaaagtgcttgtgatgcactaacacatctagtatatttgggaaatcaagtcgaattatatacagatacgtttggtcgtaaagagagcaatcccgatccaagcatctctttatcccccctaactaaagaacgtttaaaacatatacaagaccacaaaaaagaatattatagtatctctgaaggcaagaaagccattgagattaaacaaattggaaaacaatatcaagttacttttgatgacggtagtactgcggagtctttccataaacctattctttccacaggttttctaaatacctgtcatctcattgacggaatcgctttatttgaatacgataaaaatcagttgccaatagttactgaagatgacgaatctactatcgttaataactgtttcttaattggtccaagcttacgacaaagagatactattttctgctatatttataaattcagacagcgctttgtccctgttattaatcatatcgcacaacgagaagggattatattagacgaagatacccttgaattctttaaagaaaatcaaatgtaccttgataacctagcttgttgcgatgtcaattgtgattgctaaaaaatcgctagctttattgctagcgattttttaatattaaacatttgctacttgaggtaaggattctccaatagcttctaaacgttctgcccattcttgacgtgataaaccattttcttgcacatagcgattacgttcatgtgcacgacattcaggcgagcaccctcgaacatacttcgcttcgttttcttctgaagcaaaaatttgtttgttacaaaacggatttgcacaattgacataacgttcacaaggtgttccatcaaaataatctttactaataacagttggattaacatgattaattggcaccgagatacgatcatcaaaaacatacatcgcaccatcccaaagttcaccttgaacttccggatcttttccatatgttgcaataccaccgtgtaattgtccaacatctttaaaaccttctcgaaccatccaacccgagaatttctcacaacgaacaccaccggtacagtacacaacaacacgtttttccataaacttatctttgttgtcacgtacccattgtggtaactcacggaaattgcgaatatcaggacgaattgctccacggaagtgacctaagtcatactcataatcattacgcgtatctaaaacaacagtatcttcatcaagcaaggcttctttaaattgtttaggatttaaatactcacctgttgtttccaaaggattaatatcgctatcaaagttattatcttctaacccaaggtgcacaatctctttcttataacgaacaaacattttacggaaagcttgttgattttcctcgtcaatcttgaaccaaagatcagcaaaacgctcatcgctgtggacccaatccatatacttctgagttgtttcataatctccagaaacagttccattaatcccctcatccgcaatcaaaatacgacctttaagcccaatagatttacaaaattctagatgtttcgcagcgtactcttccgcattttcaattgaaacatatttataatagagtaaaactctgattttttctgacattttttctcctcatctgcaaaataagttagtatacttcattatataacgactccttacaacatagcaaaaaatacgcttaggacatattctttgctttaaagacaaattattcttcttaagaacacacatatgttaaaatagtaaaagactaggaggacttttatgacttatgaattatgtctagaatacggtacttatccacttagacctgtagatgcttgggctgatgaaatcaatactgcacctgcgtttattactgaagataaaaaacttttagaacttttagaagaagtcaataccttattccatgagctctttttaacgatagaatgttccttccactatattggtcatgacttcccagaaaaaagagcaaaaatcacacaaatttatcatgtgattatcgaacatttaagcatacactaccctgaatatgacattaaaattgaatcattattaatggggtagttttattttaactaggtagaaactatctattaaaaacaatcgatatcactaattacttcaacaaatagattatctaaaacaaaaaaggtctctttcaagaggccttttttcataacttatctcactaaatattaaatgatacttttaccaaataatatcaccaatactctagactcttatctcttgaaagcaaggtacagacaatagccgcaaatccagaaataccaaatattataaatgctactccccaaccaaagtggtcaataataataccaatagctagagtagcgatcgttgctcctccgacataactaaatgtgccagtcaatcctgaagctgctccagctgctgcttttggaactaactccatagcatacaggccaaccatcataacaggaccgtagattgatgcccccaaacctagtaaaataatgaagtctaatgccatatattgaggtcctgctggaataaaccaataggcagctagtaataagattgctacaactaagaaggctacattggttaaaggtttagagtttttaaacactttggcagatagatatcctgctgttagcatcccaataataccacctatttcaaaaagtgaaaaaccacccataccagctgttgcagtaataccttttccaccatcttgcacactcgtcgctaaaaacttaggagtccatgagacaataccgtaacgtaaaatatatacaaatattgaatacaaggatgcccacatcagtttagtatttggtagaatatatttttttataatttcgcccatacccaaaacttcaggctcttctaaaatgtcacttgaatccacaacattagtatattgctctttatgatactcttctataggcggaagtccgatagattctggagtatcttcttgtaaaaagtaaacaagaacagccaaaagacaagccaccacccctggaaaccaataagcagcacgcgcttgattaagagaatcattaccagcaagagctagacctacaccagttaaaatcggcgctattgctccaccaaaattgtgagataaattccaaatggtagcatatttaattctttctttattatcataccaatagactaatgtacgcgctccaggagggtatcccatcccttgtaaccaaccattaataagatacatgatagtaaagagccagatactagtaattacagatggaataacaccgattaacacattaactagtcctgtaagaaacaaaccaactggaaggaaaattttagaattcgattcatctgaaatcaaaccagaaataaatttagagagaccataagcaatgtagctagcacaggtaataataccaatctcagtagcagacatattaaggataccagataaaattgaagtcgtattacgaacaaaatagtatcccatataacctacaaaaatagaaataaggacttgtacacgataacgaggatatttatgcttaatttcctcagctgataaacgttctcttttctgagggggtgcaaatagttttttcaacatagcaaattacctttccgatttttagatgtgtttaattatacaactatgaattcacactgtcaattaattaataatttattttttatcattttatcttatttttttaaatgtggataatactctttaaagtgtggataatactatattataaagctttttatctgatttttctgtattttgaaatcaaattatattttttaattttagtttatatttcaaaaattaaaacaccctataaccaagtatcacagggtgcatatttttatattatatagaatataaatacacatgcaattaaatatttagaataagttctgctcagttctatttttaaagtctacggacaaaaataaatacttatagttttattagacaagaaaaaagtaaggttgaaaaccttacttttagagactttttaatttgaatgccaaatatcttgattatattgttcgattgtacgatctgatgagaagaaccctgctttagcaatattgtgtataactttcttattccatgattcataatcttcataatcagcaagcacttgttctttaacagcaatgtattctttcaaatcaatcaatgtcatgaaccaatctttacctactaactcatcatgcaatctctttagtcgttctgcattaccgagtgacactatatcatcactaatgataaaatcaacagcttcacgaattactttgtctttatcatagtaatcttttgaacgataaccagatgtttcataaagattaatgatagtatcagagtctttaccaaatgtgtagatgttctctttgccagctaattcagctatttcaacatttgccccatccatagtaccaagagtaagagcaccattcaacataaatttcatgttacctgtaccagatgcttctttggaagccaatgaaatttgttccgaaatatctgttgcagggattaacttttccgctactgtcacattgtaattttctactaaatggacattaaggtatttattaacttctggatcattattaattaattctgataagcagagaattaagtgaatgatatcctgtgcaatagtataggctggagcagctttaccaccaaaaataactgttaatttacgtgatgggaaatgcccacgtttaatttctaagtatttatgaataacatataaagcattcatttgttggcgcttatattcgtggaatcgtttgatttgtgtatcaataattgagtattcatccaattcaatacctttattttccttaaggtaacgtttaagagccagtttgtttttaaatttaatagcagctaatttatcatgaacttcattgctatcagcataagttaacaatttttcgagctgagtcgcatcagtaagatagctatccccaattagttctttcaagtaatctgctaaatcttggttagcaaactccaaccagcgacggaatgtaataccgtttgtcttattgttaaacttatctgggtaaatatcatagaaaacctttaattcactatttttaaggatttctgtatgtaatgctgctacaccattaacgcttgttgagaagtggatatccatatgcgccatgtgaacacgtccagcttcatcaataatttgaacctctggatttgtttgctcttcacgaatcatttgatctaattttttaatgattgttactaggtggggtactacctcattaagatactctaaaggccatttttcaagagcttctgcaaggatggtatggtttgtatagccaaccatattgcgaacaactgacacagcttcgtcaaattcaaaaccatgtttttctgtcaataaacgaatcaactcagggatgaccatagatgggtgagtgtcattaatttgaacataagcatattcagctaaatcatgaaggtttgaaccacgctcgattgcttcatcaattaataattgagcagcatttgaaaccatgaaatattgctgatagatacgtaataattctccatttttatctgaatcatctggatacaagaacaaggttaaattcttcttgatttctgtcttatcaaaagtgatacctttttcaataaggttataatcaagtccatcaatatcaaaaaggttcaaataatttttagtatctttcttataacctaatacatcaattctatctaggcgtgattttaaagtaaagtcacggaaaggaacatcataagaaatatctgttggtactaaccaagaattattctcaatccagtagttagcttctgcttcttgttgattgttgcgaaatacttgtttgaaaagcccacagtgatagtttaaaccaacaccttcaccattaatacctaaagaagaaatcgagtcaataaaacatgatgctaaacgccctaaaccaccattaccaagtgatggttctggctctacatcttctatttcagcaattgatttacctacaagttctaactcttttttgacatctttataaatccctaagttaatcaaattatttgaaagtaatttaccaattagaaactcagctgaaatatagtataccttacgttgagagctattttttgatttagcggcagcttcttcttttacaaaatttaacaattcaacgtaaatctcttcatttgttaattctgataatacttttccttgttgtccaacgtaagttgtaaaatttcttgtcatgataatattccttatttattccctctattataaatagttgtaatctcttttaagaatgctttgcgattttctgttaagtcttcttttctcatacgccattgccagttacctccaacggtatttggcatgttcatacggctatctgcaggtttatctagtagatcttgcatacatgtaatcgttgtttgactaacggttgcatacaaggtacgcagtacagtctcagtaatgggctcatttggcaaacgacgcatgtaattttctgcataagctttctgttcgactgtaagattttcaaaccagccattaataacttcgttatcatgagttccagcatatgcaattgtattttctgtgtagttatgaggaatatcaatactatttcctgttgtatcataaaaaccgaattccatgattttcatacctgggaaccctgttccagccagtaatctctctgctctctcatcaatatagcctaaattctcagcaataataggtaaatcacctaatttttctttgatagttgcaaataattctggaccgggagctggttgccatgagccatcattagctgtttgataatctcctcgaatttcccaataatctgaaaaacctttaaaatgatcaatacgcaaatagtcatacatcttaacaccagattgaatacgataaatccaccagtcaaaatctgactctttgtggtaatcccaattgtaaataggattgccccaaagctgaccatcgtcagaaaaatcatccgctggtacaccagcaatagcaagtggttgtttgtcgcgatctaatttaaacagttcaggcattgtccaaacttctacactatcggcagaaacgtagattggcatatcaccgataatttgaatccctttatcattagcatattcttttaactcaaaccattgtttgtaaaagaaatattgcgttacttcatgatattttatcacttcactaagcttttgacgatatcctgctaaggcttcttcttcgcggcgtataatagccttgtcatcccattcttgaagcgccttattaccaaaatgttctttgatcgccataaattcagcaaaatcagttacccatttttcttcttgcaagaaatcagatagcattctcgtagctctctcttcttgcaagaaatttttaactgctttttctaaaactggacggcgtttttcaaacagaccagcataatcaacaacttctggatcctgtccaaaactaatattttggtagtcatctttcgaaatgaaaccttcaagcgttagcaaatcaaaatcaattaaatgtgtattaccagctactgcagaaaaagactggtaaggagagtccccgaagcttgttgttgttaagggaagaatttgccaaaatttttgatcagtttcgaccaaaaaatcaacaaaagcgtaggcttctcgtccaaatgttccaatacctaaatcacctggtagagaagtgatgtgcattaagacaccacttgcacgttttttcatattgattctccttttcgattacttactttactcctccatcttaacgcaagcgattgcataagtcaagcataatttaaaaaaacttctatcgaaaattgatagaagtctttatatcatagcttaattattatttttagaaatatctcggacactttcacgctcttctaaagtaaaaggcacaataatagtctcactaaagactttgtctggagatttaatgatgtcaatcagacgacgaacgcttgtccttcctagattattaacattaatatcaaatgtgcttaggtaaggatgaatcagatgtgagaagagagaattattaaaggtcatgatagaaatgtcatctggaacttttaatttatagaaagaaagaaattgcattactctaacagagacagtatcaccaataacaattaaagcagttgtttcttcttctttgactctatttataaattcctctaaaacttgcggattgcctctgtcaaataaaagagctggcttttggtttaaacctaactttctagcacctttaaaataccctaaatagcgctcttctgatacttctgaatttaaatcatctgtaacaaactggatgcttttatgtccttttttatagagataatcaatggcagatttccccatcagctgattatcattatcaatataagtaatctcattttcatagccattagcagcaccaacaacaacaaagggcagtttatattttaataaatactctctgataggatctttttgatccgaatagagaacaataaaaccatccactcgtttttgtagatgcattaattttacttgttctaacaactcctcagaagacatacttgttgcaatagaaactgtaaactcatgctcttttgcttcattagttaatgtagaaagaatctccatgaaaaagggttcacttaagcggtctggtaaaaccagtggaggaaaaataactccaatattttgcgttaaaccactagccaacatttgtgctgcaacattaggaacatagcccagctcttccatagcttttttcacgcgctctttcgtcttacttgaaatagatgcattatcttttagtacacgacttactgtcgatggattaacaccagctttggcagcaacatcttttatagttaccatcctacgacctcttcattctaatcattttataccttttggtatagtcctttgtctattatactctaatctaagaaaaaaacaaacgtttgccttctctgcaaatgtaatactctcactaaaataatcttctcatttagtattaattgatattatttttttatttttcttattttttttaaaaaaagacttgactttttttgcaaacggttgcataatataggtgtaattaaaatattctctaggaggagaaccaaaatggaaaaaaatacttggaaaaaattacttgttagtactgctgctctttcagtagttgcaggaggagcaattgctgctactcactctaactcagttgatgctgcttcaaaaacaactatcaaactttgggtcccaacagattcaaaagcgtcttataaagcaattgttaaaaaattcgagaaggaaaacaaaggcgttactgtaaaaatgattgagtctaatgactccaaagctcaagaaaacgtaaaaaaagacccaagcaaggcagccgatgtattctcacttccacatgaccaacttggtcaattagtagaatctggtgttatccaagaaattccagagcaatactcaaaagaaattgctaaaaacgacactaaacaatcacttactggtgcacaatataaagggaaaacttatgcattcccatttggtattgaatctcaagttctttattataataaaacaaagttaactgctgacgacgttaaatcatacgaaacaattacaagcaaagggaaattcggtcaacagcttaaagcagctaactcatatgtaacaggtcctcttttcctttctgtaggcgacactttatttggtaaatctggtgaagatgctaaaggcactaactggggtaatgaagcaggtgtttctgtccttaaatggattgcagatcaaaagaaaaatgatggttttgtcaacttgacagctgaaaatacaatgtctaaatttggcgatggttctgttcatgcttttgaaagtggaccatgggattacgacgctgctaaaaaagctgtcggtgaagataaaatcggtgttgctgtttacccaacaatgaaaatcggtgacaaagaagttcaacaaaaagcattcttgggcgttaaactttatgccgttaaccaagcacctgctggttcaaacactaaacgaatctcagctagctacaaactcgctgcatatctaactaatgctgaaagtcaaaaaattcaattcgaaaaacgtcatatcgttcctgctaactcatcaattcaatcttctgatagcgtccaaaaagatgaacttgcaaaagcagttatcgaaatgggtagctcagataaatatacaacggttatgcctaagttgagtcaaatgtcaaccttctggacagaaagtgctgctattcttagcgatacttacagtggtaaaatcaaatctagcgattaccttaaacgtctaaaacaattcgataaagacatcgctaaaacaaaatagtacgtctagagtaatgagatgaggtgagtactcttcctttcaattgagagtgcttcccatctcttattttgtaaaataacaattaaaggagaccattatgaataaaaaactgatctcacttgatggtatgtccctaaaagaggtctttcaaaaaggtgatttagcaactaaactatcattcttaattatgggacttgctaacctcaaaaataaacaaattgtcaagggacttttatttttaatcagtgaaattctgtttttaattacctttgtttaccaagttatcccagctgtaaaaggtcttatttccttagggacccaagaacaaggtatgacaactaaaactgtggatggtattaaaatccaagttgcgacacaaggtgataactctatgttaatgctaatttttggattagcttcgcttatcttctgttgcgtatttgcctatatttactggtcaaacattaaaagcgcagcacatttattgaccttgaaagaagaaggaagagaaattccatccttcaaaaaagatattaaaagcttgacagatggacgcttccatatgactttaatgtctattcctttaataggggtgcttctatttacaatccttccgttagtttatatgatttgtttggcatttactaactatgatcataaccacttaccgccaaaaagtttatttgactgggttggttttgctaacttcggtaatatctttagcgggcgtatggccagtactttcttccctgttctatcttggacattaatttgggctgttttcgctactgtaacgaatttcttctttggtattattcttgccttactaattaatacaaaaggtttgaaattcaaaaagatgtggcgtactatttttgttattaccatggctgtccctcaatttatctctctcttaatcatgagaaacctcttaagtgacgctggaccggttaacgccttgttaataaaatggggacttatttcttcagcacatccccttccattcctttctgatccggtctgggcgaaattctcaatcatctttgttaatatgtgggttggtattcctgtaacaatgcttgttgctactggtatcatcatgaatttacctgcagaacaaattgaagctgctgaaattgatggggcgaataagttccaagtctttcaatcaattactttcccacaaattttgttgattatgactcctactttaattcaacaatttatcggaaatattaacaacttcaacgttatctacctactcactcaaggtggaccaacaaactcaacatactaccaagcaggtagcaccgatttacttgtcacttggctatacaatttgacagtaactgctgcagattataacttagcatctgttgttggtatcttaatctttattctttcagcagtatttagtttactagcttacacaagaacaaattcttacaaggaaggggcagctaaataatgaataagaaaaaacgtcttaaccttacttttgtttatattttattgatagtactatcaattatgtggctctttcccattgtttgggtcgttctcacaagcttccgtggtgaaggaagtgcctttgtcaactactttattcctaaaacttggacattagacaactacgctaaactcttcacccaaaacacattcccatttggtcaatggttcttaaatacattatttgtcgctacatgtacttgtatactatcaactttaatcactgtagcaatggcttattctctcagcagaatcaaattcaaacaccgtaatggtttcctaaagctagctttagtcttgaatatgtttcctgggttcatgtcaatgattgcagtttactacatcctaaaagctctaaatctagaccaaacattaaccgctttaatatttgtctattctgcaggagcagcattaaccttctacatcgcaaaaggtttctttgatactattccatactctttggatgagtctgctatgattgatggggcgacccgtttggatattttccttaaaatcaccctaccattgtcaaaacccattatcgtttatactgcattaatcgcttttatgggcccttggatggactttatctttgcaaaagttattttaggtgatgctacgagcaagtacacagtcgctattggtctcttttcaatgttgcaacaagataccatcaaccagtggttcatgtcatttacagcaggatctgttattattgcaattccaatcacaatacttttcatgttcatgcaaaaatactatgttgaaggtattacaggtggatctgtaaaataatcttcagataatttaaagacacgacatttttatttcactgtggtttcttttctaaaaaaggcttgggttctattgaattcaagcctttttctaagctagatagttaaaaaacttggtttaccaagggtgttaacctctacaaaaaaataacttgatagtgctaagtaatttgacagttgcttctatttactatattattaatagtgttatctacaaaaggagcgtttttcatggaaaaaacaaaatcattctttggacatcctcgtggtttgtccactcttttctttactgaaatgtgggaaagattctcatactatggtatgcgtgctattttgctgtactatatgtactatagtgtttctcaaggtggccttggtatggacaagactgtcgctgcatcaatcatggctgtctatggttcactggtttatctctcatcagtaattggtggttttgtcagcgaccgtattctaggtagtcgtaaaactgttctgtatggtggtattctaatcatgctaggtcatattgctctagctacaccatttggtcaaacagctctattcatttcgattgctctaattatccttggtactggactattaaaaccaaatgtatcagagatggttggtaatttatatggagaaaatgattctcgtcgtgatgctggttttagtatctttgtttttggtattaaccttggtgcttttatttcacccattgtagtggggtacctcggacaagaagtaaatttccatcttggtttctcacttgctgctattggtatgttctttggtctcctccaatataccttagatggaaaaaaatatttgactgaagagagtctcagaccaaacgatcctttaagtcctgaagaaaagtcctctctatataaaaaagttgggcttatccttattggtattgttattgtacttattctacttcacttgatgcatatgctaacaattgaagtaattatcgatatttttagtattattgcaatcgccatcccaattatttattttatcaagattttaagtagtaaaaagatttcttctgttgagcgttctcgagtgtgggcatatatccctctctttatcgcctcaattctattttggtcaattgaagaacaaggttcagttgtcttagccttatttgcagatgaacaaacaaaactttaccttaacttctttgggcatcatattaatttcccatcaagttatttccaaagtatgaaccctctcttcattatgctttatgtaccattctttgcttggttatgggctaaatggggaagtaagcaaccttcatcacctaaaaaatttgcgtatggacttttctttgctggagcttcattcttatggatgatgctaccaggtttactctttggagttaacgctaaagtaagccctctttggttaacaatgagttgggctattgtcatcgttggggaaatgctaatctcaccagttggattatcagcaactagtaagctcgcacctaaagcattccaagctcaaatgatgagcatctggttcttaagtaatgctgcagcacaagctattaacgctcaaatcgttaaattgtacacacctgatactcaaactctttattatggtgttgttggtggtataacagttgtatttggatttatcctcttattttatgttccacgcattgaaaaactaatgtctggagttaaataaagacatctaaaaagaactaggttacattcctagttcttttttgtttaataaaattttcttataaaaccatcttcaagtcgcttactataaaacatctctgagatgtcatcttcgtcaaatactctcaaaaagttaagcatatcatatgctagttcaatcttatcaagttgtgaacgttcaatccatacaacatcaccttcatctgacgattgtaattcacctgaaaaatcatatgttttataaaggaataccaaatagcggatgccttcatctgtgtaccaatgcttcataccaactaatttgggattacttattgttaaacctgtctcctcgtgaacttctcgaacgagagcattctccttcttcaatatggccgcctggtaaagcagctcctgaccaagaataacgtttaggatcacggatttgcatcacaatacgtcctttattatcttcaataagacacatattagttaaaataactttttgactgcgtgacattttttcctctagtatataaatttagtgatagagttacaataccatttatttatcaatttttctacaaaataaaggatagtaacttaactactgtaggttaagaaaaatcgaataattccgataatagacatgattaaccctattaaaatagaaataatcagaataagctgcatgtcaaatcgttttttctctcttttttctttaggaatttgatatcgctcttcagatagacgtttattaatactctcctgaagtaaattcttttttttcaaaattttccccttaattaattacagattgatactgagtagagcttgaaacatgacaatcttcaagctgctgttttaatgctttttctatattacatttattgccaattagtggctgcaagtgcgaaataaatgtaaaaatatctttttttggaaaaatatttttaggtgatacaaaacgaatttgatgactagtctcttcgaaagcaaaaattaactgttgatgttcaaaagcagagcgaactgctgataatatctcattatgatgattaatatcaagataaaaagcacaaatatttgataaatattgtatttgatttgttgtgatatttgggtagagtacaacattatcatatttgccaaaattcatgagatcactagacatctcggtcaaagcacctatgttaaaagtcaaattaggaagagaagtcactaaactttctaatgcttcgatttgatcagaattcgtcaaaataagagcttggttatgtaatttttctgtctctttaagaggatacataaatcctaaaaagctaacttgtttttgttcttcgtcagttaataacctcatagcattagcataagcttcataactttgaattacaattttagtgtttggggaaggattgttcaataataagcgcatatttcctggaatatcatctacgagaggctcctgccaaaagagaacatctttactctctagacgattaaggtaaaagcttactaaaaatggtgttgacagagaattatagaagattctatctaagttaaattttgcttcttgaagataatttatgacaaattcaactttagatttaaaaaccttaaactgattattatcatttaaaatataatcccctgtcatatggttctctgatataacctcttgcctatccttattataatatgacgtctgaatcgcttgaccatccgcgttataaaaggtttgtgcaaaacagaacccaaacttattaaagcgatcttttaaaatgactctaccttgctcatcaaaccagtctacctcttttattagacgcttatgatttgggtttgcataaataattctgccctttttgacacctaagtcaacaatatcagcaccactactaaaaccaataatttcccatgtatcaggaactctaagttcattgtagtaaagtgggcggccagcacctgtctttgcaaaaccagtgtaatataaatagggtgatgttacgtcgtctggtaaaaaaccatcatcattcaaagctatagtagggttaatataacctgattttatcaaggaaaaatgtaaatcccaacttgattgagtgtaactatcaaataagttaatcatcttgtaccaactccttaactaagttataccattttccttctacttcatttgttaagaatccttcggcaatggcgtaagaagcttctcgtaaagccttttgatcctgttggaataattgtaacactttctctttaaaagcttctacaatagcttcctcatcatccatatcaaatcgaggaattagataaccattttctccgtctttgataaaagtttgattaccataacgaacatcaaacccaatcaaaggaagtcctgcgccaatagcttcaagtaaagttaagccaaacccctcacttttagaagctgtcaaatataactcataattttgataaacattcgagagatttttatgtcccatcaatcgaatgtattccgttgcattggctgcatttataatatttctaattttttcttcttctccacctgatccatagatatcaaaggtcacttcaggaagaatttctcttatcctaataactgcacgtactaaccaatctacatgtttttcactagctaggcgtgaagctgtcaaaatagagtacggacggcgattgtccattggcattttaagattgtcaattgagcctaccgggatagttataattctaggattatgatttgtaaattgtttaaattgttgttccaaaagttctgtttgtttatcagtggaggtaataaaaaaatcaaatctattagcgttagtaaactgataatcgtaatagttattccataaaatagtgtcagcagtcacagcattctcactaaaatgttccgcatgaacaacagtccctagcttagcgggtttaccatggcgcaaaagactctgagcggtatcagttcctctatccaaaagaataatatcttttgaagtgaaagtcattgattccaaaaaataatcaaaaaaagctactttggatggtaaaagtctgccattgataataaaacgacttgagctattttctaccatctccaaaaaggctgtactttcatcttcattgtagaatctacgttgataaaggtgagctacaccatctttaggatagtaatactctgagaaagtacgtgtataactataataatcttttctgataaggttgttatttgaaacgatttctacacgatgcactttatccttgttaaaattatcaaggtaaactgttaaatagatattttcatcttcgtagaaaaacttgattacccgacctttatcttcttttcgaacaagttttccaagatattgtttttgcaaatcttctatactaaaagttgtcggggcaagctcaatatctgaaaaaaaattatataaccaaataatttctttatcctgaaaacctatatttcgcgtgaggctaataatattatcagctgaaaaaaaatctgtaaaaataaacttagcatcaattccaagttttctcaaaacagaacctcggtatgcttgagcgtactcaacaccgctgcttgcccaaccaattccatggtttatattataaactgtcattatctttcatctcttatataaaataaatttgaagatctccattctcattgaaggatacttcactcaaaagtagatttctaaaagtttgttcacgaatttcttttttcatgatattgtaggatttatatgcttctttatgatattcgaaaaccgggttacgctgtgccgtttgacgagctgttgccacagtacgtaattgttgtagataatctacttcttcaatccaagcttcatcaatcgcttttaaagcagcagtacgttcaaagtcaccaaaactatcaccaagcaaattatgcttttctcgaagaatctcatcggctattttgaataaatagtttttaatttcttcaagtgacatctctttagaaatcccttgaagattgtaagacatattatcaaatataaaacgatttacttcaaaaatgagttcttctttttctacttcaccatctaaataagcaatgaaggaagaaatcactgtatcaataatctgtcttggactaaaatgtccactttctccattgatcaaagcatttctctcacgataaacatactctcgctgaagctgtacactcgaatcaaactctatcgtttgactacgtgcagactctcccttaccgtcactagcttcctgagtttgctggaataacttctgaaatcttctctgacctaaggctttaggtttttctggattaactttgtcacgatttttcctaaagtaatcttgcgcccatttaggacctgattctatcattagatcatcttcaaatgatacaaaaaattgactaaaaccaatatcgccttgtcgacccgaacgtccccttaattgtaaatccattctttgactcttcattctctccgttccaataactgcaagaccacctaattctgatactcccttacctaacttaatatctgtaccacgaccagccatattcgttgcaacagtgaccgcacctttttgccctgcttctgcaatcatctgtgcttccttaaccgcactttgagcatttaacaggctatgagggataccacttagtaataataattctgagaatagctctgacattctcacagaaccggcaactagtaggattggttgtcctgtatcatgaacctgtttaacaaattcaatcgttgcatggattttctctggtaaggttgtataaatcttatcaggatagtcaattcgtctaacaggagaattagttggaattctaactacttccatatcatagacctcaataaactctttttcagcagtttttccagttcctgtcattccagccaatttagtaaacattctaaaaagattttgataggtaatggaagccattgctcgagactctggtgtgacattaagatgctctttttgctcaatagcttgatgaacacctccttgaagtttagtaccttctaaaacacggccattagtcgcatctagcaacttgatttcaccatcgtcaaccacataatcttttcctcgttcaaataatttatgtgcttttaaagataagttcaaatgtcgcacaagttctcgattagactgtttataaaaatgagggattctaaaatatctctcagcttcacgaacaccctggttttttatccacacttcctgacgctctttgtcaaaataataatcaacttgttcttcaaaactaagaattagttcatctgctattttatagagattagattgtactcgaggtgaacctgaaataactaaaggagtctgggccatatctagaagaactgcatcagcttcatctacaatagcataatgtaacttgggcatatatttttgagatttagatgaagctaggttatcaattaaataatcaaagcctagtgcactacttgtactatagacaatatccgaactataaacagctcgcttagtcgcagcatctctatcctcttcctcattatcagaaactcccacaccgacactcaatcctaaaaaacgatatacttttcccatttcttccgcatctcgaatagcaaggtaggaattattagtcagcaacattgcccccttcccttctaaagcattgagatacaaaggcatagtggcagttaatgtttttccttcaccagttttcatctcagcagtatttccttggtgcagaacaagaccaccgattacctgtacatcatacggaaatagacctaatacgcgctcatcagcttccctaacaacagcaaaagcttcagcacaaatatcatctagtgtttccccattaactaaacgttttctaaattcagttgtcttagcttgcaactcctcatttgatagtgttgccatttggccctttaaactattgatagtatttaaagtacgctgaagtttttttaaacgtttcttatctaacgaaaataaactattaaaggctatcataattgtcgtcctgcttttttaaaagtgtgaggtaaggtagatgttcattaccagataagatcattgatactaaatttaaagaggaattttctgaaaccaatccatagtgctttacatttggagacgtctctctcgtatcccagacttctctaagaaatatttgttgtttggcagtcaagtgtggtaaggatttaagtaaaattccgaaaggagcaaaacaatcattaatataggcagttattctgggaaattttttagcataatataaagcagcaaaattaccttgtgttccatacgcaatgacattaatcttaatgttaggaaaaacttttaatgcatcttctaaccccttttccaactcaggtaatatcaaactatcagaatttaatgagggattgctgaccaactcgactttctgttgcaattgagaaatgctttctattttattaatatatacactatcttttttctcgaccaaaagaagatttaaaacgtcttgatgttcttcaatagtaaactctgtcgatagatttttctcctgaataacgctatctgtaacttcctcaagtttcaaataatgaaaagtaaaatcgctacaacctgcattaatcaaactaatggtataggtataagcctctttaggatagataaaaataatactatctttttttaacagttcaaaaccaacagactcattaaagcgattgtaaaattcaatgcgaacaaaaagagagctaactaaatcgagttctgcatttaatgacaagctataacgagttccctttcttagtaaaggtaagttaggagaaattctttttgactgataattagtctgggagctccatgtatacaagtttgtgctagaaggagctaatggattttcaaagcatactgattttcctaaaaattgtaattttgttccaaaattataagaaaaccttgaaaaatcatcccaataaatgtagcttatcgtactcattcttctttccttccaaaatcattagatagcattcgcctatactgacttgtaaaccatgcaccaacttctgcagaacaatcaccatgtcggccatcccaacctctgcctaatatcttatgcttctttcctctaaaatattgcaataaatcagaaaaggcagtcgcatcatagtcatcgtttttcatataggctaaggcaaaagtcgtatttgaaaaatctccttcttctatagatttccaaaaatagttatttaacttctcagaagaggaactggtcaagtcaccttgattgagtagttgaatatctaatgaagtagcaaatccatctggtctctctaatctttcacgttgagcaactgttcctaaattaaatattggtttaccaataataatagcatgaggatttagcttagcaccatggtaagtagcaccataagtccccattgaaagtccggataaaattaactgatcagaactaaaatttaaaaaggccagtttttcttgaatagcatcaactattttttgttcatattctttgcttcctatataaaaggcaccaccttgtaatcgtggatcacaaattaacatgaatggagtcttcatactcttcatcatccagaatccctcaaagccttcagctgaacgaaatcccgaaaaataaacagttagaggtggtttgaaatctactggatcaaaataagtcataaattcatgacctatagcatctatgtgacgttctcctcctagtagaaatgtgcccaatcctcctctaccattacgacggtgcaatggacctaacttaacgataccctttcccttagcaaaaagtttaactgcaaggctaccactaatatcggactctaaagaaataagttgatttaggtcttccttctcaaagtaccactctttagcaatatcatcaacagaaccatcaacaatcaacgagataaccaatcgaatatctatatcaccctctataatgtgttctaaaaataactcattataaaaatccgatgaaaatggaatattgtaagcaaaattaagcaaaaaactatagttctcaccaaattgcccttctaattcaagatagttatttccctgatagtttactacaccttcaaaatcatttctaatttgtatttgtgaaacttgaagtttctctccgtattgtcctataaaaagccctttataaaattgacgaattagctgatctggagagctactatcatatcgttgggccattttcgagcgtaaaaactcttctgttatccccgtagcatgtttatctttaggataaaatacttcataaacctcaaagaatgacgataaactagataactctggtccataagtttgctctgtcaacaaaagagcagatatttttcgaggtagtttttgcaataactttgacgatgtaagataattattttctgtagttacaaagtcagaaatttgatctggtttaataaagagccattccatattattagggatattctctttagttgcccagttctcttcaccaacttgaagaattgtaagttttatttttgacatatttatttaataactatttataattctttctaccaattgaccacctgtatagtcattgattttatcaatagaataaattaaagaacggttccaattagttaattgttcacaataataaggaattgccttttccaattcttggatctcttcaataatgtaaccgtttttcctgtgttcaacaaattctgttaatattgtatttatctgagggatacctgaacttatccctgcaatttgcgtgtataagtctggtattttcgagatatcaataatcaaacggacatactctaaccggtttatgatatctgtttctgacaaaggatgggtaaaagaaaggcgtgttttttccttttctacttcatcagattgcataagaacttgattggcatcatcgtctgataaactaaagaatttctgatcaaaaacttttgttgcttctttaaggtagtcatatgtcaattgccgactttcaaattctcgttcgtagctgacaaatgttacttttatatcattatttttgagcataaccttatataaggatgttaaagacttttgcaattctttatgggaaagtctatctacgacaaaatatatttctaaatctctaacttgattactttttcccaaagctaaacgcgtatcaaagggagaaacatgaacaactggtttatctattttttctttcaattgtgcagcaatatctagtctatcacaaataatagcgtctgctcgagataaggaagagtaatcctccaatacattgtgagcattattcctctccgagaaaacagataatattaaatttcctttactagtgttcccaacaataaatgcgttatgaacttgattaaagctaacaatgatagtatctgatttactaacttctttatggagataggtcagatatttctctctaatcaactcttcaatatcggagtaagataactttaaaaaatgaatagctttcttaggattaatttcaacatggtggtcaccttctcttaggtattctctcatgatcctttcccctgatggtgctaaataatcttgataggcttcaccaccattatcataatagagaatactagatagaaatcctctatcatcaaagaggtatttcttagctatttgttcatttgcaaaataatcaatatgcgttaaatttccttcttcaccaaattgaaccttagcaattaaatctcctgacttttttaccaaaactataaacggagtataggtaaagtccaccccttcaggccaattgagttgtcggaagtcaatcatttgctgtcttacattcccaatttcttgaatatcatcaaaaactgaataataacctgattctaacaagtcatagcgatgtaaataataacgtaaattgggcatatagtttaagacaactaatctactctcttttccagcataatcaaacatcttcatttggttgatagtatcatcaaaaccgacattagtcggcttgaaataccacaagtaattattatcataccaagtacgattttcattataccaagatggaataaaatgaaacattaattctcctcattttcaaatacagaagtgtattgtttacgaatacgaataacttggaattcatccaatatcataaatgacatccctgtgatcatcataaaaatccctgtcatagatgaaactgtcctaagatcatcatttccaagagcaaataataatggtacccctcctaagaaagccatgaaaaaaccactaaaagttccaaataaataacagattttcgataaataactttgtgtttctttaccaggtctataattaggaataaaatcaccactttctcgcattgcctcagaaattttagtcggatcgatattcacaaaagtaaatgcaactgataaaacaagcattaaaatcatataaataaccactccctgaatagaagataaactaaaatagtcattgtatgatgtgatatctggattagttgggaaaatacttcttagtaaaataataatatactgggggaacattagtaaggtataaacatacataaatgccatcccccccgaagcatttacttttattggcatgtaggcatcatcaacgagacgattatggattgaagtacgcattactggtatacgatattctgaacgttcaaaagttatcattaagtacattgctactagtgtccacaaaagaaataagatgatagcaagttgataaccatcttggaataattcaaaaataagaggaatattattaaattgcccaacaagcatacctaccaccactaaaatagtcattccaccaaacccgtattccgcatttagattaccaatccaggaaataatatatgcaccagtcacaagtatcattgtcgcgagtaataatttggtcagagaaaaaccattatgatattgaaaagatatggttatggctagcccttgaataattgctatgacaagcatcaccacattttggcgaaactgttgaactttttgagatactccactagagtatttaccaatcgtaaatagtcttagtaaaatcattgtggtcatcataggaccaatacccaatgaaaagaccccaacctgagacaaattaccaccagttactgttgaataaagcgtcgcaaagttattgtcttgtcccttataagcagaaatcaagacaccaggtattggaacatagcgaccaagtaaaaaaatgattattaatgaaaatgttatcaatattttacgaagaataatatttttttcaaaaatatatagtaatttcaatggaatttctctttctctatcaatttgttctcttcaagataagtaactttatatcgtcaacttcgttaattttaaaatcaagaaaattgatttcaatattcaagtaaccattactcttcttgactatctattttgtttaatagtgtcacacaaatattcaaaatcatccatggttcgctcaaaagaaatatattgattatcttttcttgcccgtctgattccatatatagttttaccctcagttatacatctatcaacaacattccaaacttcttcaccatgattaatatctaaatatatatcgctatttaataggagtacttcgaattgctcttcagtaatagcttcatgtaggtaataatttggataacctactaactgcttaagtctatccgaacaataaactggggcagcaatatgaaaatcagtattaggacatctttgtaataaatgttctagctcccatatatcatctgttaacgtcactgtcaaagcgtactgtctatctgatgtaccaatttttgatacaatttgattttcgtaactattgtcttctattaaagtaatatcttcgtcaaaattatgttctgccgtatgtttatgagaaagtttcaccttagaaactgctcccatcttaaaccactcatattctgaatcgatatgacctaaatcaatagcttgatgtcctagctgcgataaatcttcagctaatagctttgcagttggaccaagcataagtaaaattagcttacctctactatgttcaagtatagtttccttgatttcataaaaagatgaaaatgcatctttcgaaggacaaatgatacgcgaaatagtattggcatcattaaataagtcattgccaacgcctgaacgagaagtctcaccctcgacaattaaaatatctttatttttccataatgcttttagctgttcaaagtacgttactgacaaactcttatccagtaaatccatatagggtctagaaataaaagttgaaccataccattcagcctgacaatttttttggtacaaatcattatactgatatagatgatccctccaaaattgttgtgaaaaatcgttgtatctacctaaattatcaaaaacatcacttacacagataactaacttctcattactctgtcgatttaataaacgttctaatcgcttagcaagttcagaatcataaacctggtaaggaatagaattccccgcaataatatcaatttctccatcaccaaaacgcgctaccgaagcggtatgtttagaaatataatctaaagtttccgaaattgtttttactttaataactctcataactattaattcttttcaactctctttgcaagattacgacaaataaaatggtatttactgttaccttgataaccgatttgatatcactttatatattattgttttctgtaaattttcttgttctaagcgctgtttatagtcacgcattaaccaaaaatatctctctacagttgcagttgaatccaatcctgatagtataatctccgacaatttactatcaaaaatataaataagatcctctgctcttttggatgaaaacgccgatgtcataatgctatttggacgaattctatagccataatagcttccattaactaaaattgtttttttactttttataaaaagtaaaacacttaccaactcatcttcaaatactttatctattgggaaggtgatggtatcaaatagttctcttcgatataatttcccccaaataacgatgaatactgaactatttaaatgccaatgcacttgtctatcaatagctgtttgagcagagatttcttcgataacaaaatctttgtcagtgatgtagtaaccaaaaatatcttctgtttctctgtagatatagtaattactgataacaatatcagcattatatttttcttgctgagctagcagtacttccaaataattttcctttacccaatcgtccgaatcaacaaacgtaacaaattggctctctggactaattcgtgctaatccaaagtttctagctttagaagcaccgccattttcgatatggaaaactctaatacggttatctcttagggataattgatcgcagatactagcagatgtatctgtagaaccgtcatctatcagtagaatttcaaaaacttggtatgtttgtcctaaaatggtatttacacacccctctaaatatggtgctgcattatagactggaataataacagaaactaatttatcagtcactattgcctccatttttacataaaaactgtcgcatatcctccaaattaataaagcaatgacttaactccctatattcaaatgtcactgcttcattaaaactcaatatcggaattgatttctcaatagctttttgacaaaattgtatttccttccaagaagttgagatatcaaggtaataatttgctttagtcattagttgttcaaaaagtgggctggttattgaaggatacagacgaacgttagagtttgtggctaacttaagtaatcttgggccaaaagaggtccaagcagctatatggaagcaactattggggaatagttcaaccaattcttcaatataaagcaaatccacggacgttgtgaaagtaaagaagtgtttttcaaatgttggctcaggtaacagatacgtttcaaaattaaacacctcattccaatctagttgctcatattgccaccatgtctccctaaaccttgaagaagaaaaagtattccatggtttatcatgagtacagtaatggataatagtaggcgattcaaagttacgatcaaaatacccttgccaattttcataaaaggcacctaaatcatttccaacttgagcattatacttatcttctaacttaagccaattattatcaaaaagaagattgagaaccccttggtctccaaaaattccattatccaattctcgttctgttatttccagaagtttttctgttactcgatatctcatccagtaaagcgagtttattagcataacacctgagttaaaataaataccgtctccatctaagatagctgctatcgggtagtcccctaattctatctcaaacaacttatctaagttatcaacaaccaaagtatcaatatctaaataaagaactttctctgcatcaatcagttgcggaatgtagtaccttgcataagccatataggtaatatgggcacgggcgttttaaattccttaaaagtatcatcaaagagttttatatcaaaaatacaactatgactatttaataaacgtctttgaatatttctaaaccattctgaagctatatcttgatttaaaatataaatagacttcctgcgaaactaaaatcctagttcacggttgatcattccagcaatcaaattcattcgtaatccaaaccgtttgcgtcgatttcgataggttgttgaaaatattttaaacgtttttactttggcaaaaatattctcaaccttgattctctctttggatagcgtatggttataggttttatcttcaagagttagtggcttaagtttgcttgatttcctcggagtttgcgcttgtgaatacatcttcatgatcccttgataaccactgtctgccaagattttagcagcttgtccgatgtttctgcgactcattttgaacaacttcatatcgtggcaatagttcactgcaatatccaaagaaacaattctcccttggcttgtgacaatcgcctgagccttcatagcatgacatttctttttaccagaataattcgctagttgatttttttaggacgattgatttttacctctgttgcatccacaatcaccgtatcctcagcactaagatgagtttttgaaatcgtaaaaccactttgaataagagttgattcaacccattgacttcgacggattaagttgctttcgtgaatgccaaaatcagccgcaatttgttcataagtgcggtattctcgcatgtattgaagagtagccatgaggagatcttctaagcttaacttaggggttcggccaccttttgcgtgtttacgttgataagctgtttttaacacagctaacatctcttcaaaagtagtgcgctgaacaccaacaaggcgcttaaatcgtacatcagttaattgtttgcttgcttcataattcatagaactattgtaccatattttgtttcgcaggaagtctaatacttactctatcattgtgacataaaatcgattttataactgtttggatctgatttaaagatttattatcacctgccaaacaaataacgttatttttcacaatattcctttctaatatgttctttaaatcgttcattctttaaataatcaataatatccgtaactctctcaaattgtttgccttgaccatgataagttgtagaaagggataaaatatctttacctaatttcttcacttgctccagaacctgagtatctgcatcaccatgattaatatcaaggtaaatatctgaattttcaactagctcatttaatttgaaacgataaacaagtggataaagttttatatttgaatgcatttccaattgtttcaatttttctgaaatttgagtataggcagcaatatgaaattgccagtttggtaaatccttagccaacctctcaattccttcaattgaatctgagtaagtaaaaatgaaagctcgatggataggttgtaacactttcttcaatgaaacatctacaccatcattgacttgccatcttgtaaaaatatcgcgccattcaagtctattatattcccaccatatatcgcgccaacgaacagatgtttcaaggtatttccatggttttgtcgctgtataatgaataactttaggtaaatctttcctgcgatttaattgacgttcagactgttggaataggttatataacatatctgctcctgtatgatagttataagtttcatcaagttctagccaattatcgcacagtacatcattcaaaacatcctggtcatgatattgaagagccccttggttttctctagtataatctaacagtcgctgactaatcccttgttctcgccaaaaaatattattaattaatagcaaacctgaattaaaataatcttctttaccatcatattcttcgagcaaatcatctcgaacagccgctacaccatattttgaaatatcaagagtaaatatcgatgttaaatcactggtgataatcatatcacagtctaaatatagtaccttatcttcatgaataacttcaggtataaagtatcgaaagtaagtaggatagggcatcggtttttgaaatttaaaatgtttaatttcttcattaaaaattttagtgttagatattgtgcaatccattttagataaatgatattccatcatttgaaaccattcaactggaaaatcgtcatttaagatataaaaatcaataaattgattatgaaagcatattgatttaattatagtcttaacttgctcttgatagccaaaatctgccgctaacgcgatagcttttctatttttcatctaagaggacctacttcccttattcttttaaccatcaattcaggcattgtttctgagataacttctatattttttgtcgtatgtgctgtagaatcaaaggctaaaatcggtttattctcttcttttattttatctagaataccttctacttcgtaagaatgattaatatccaagtacacatcacagttacgtataagctcttccaagatagggttgataactaatttataaactttaatattgctataagtttctagattagctaatttctctgaaatatcactacgtgctgcaatatgaaactgataatctggtagagcttttgcaagtacttcaatatgttctaatgtatctgaggctgttaatgtaaataaattcagtgttttacctgttaacctgttcaaatttttttgttgttgagcataaataactgaccattctaaaccaaaataataccaccattctgaacggtatcgcgattgactatatttattccacggtttatcttgactattataatgaacaataacaggttcgcaatcatcataaaaatgatacaaatctggtcgcccatatgcattaatattgacatcttgaccaatctgaacattatattgtttaccgatatctatccaacgattctgagtcaaaatattaaggtattcttgatctcctaccccaacagcagaacccttatcagcaatcctcataaggctattataaatttcttcttttttccataatgaattattgattagcataacacctgaattaaaactaactggtgctgtatctccatagtaaagcgttgaaaaatgatctgctacagctcctaataaattctcttcaaggtttatgtcaaatagaggatccaaagaacccctaactattacatcactatctaaatataaaactatctcttcttcaaggtgaattggaataaaccatctgaaaaatcccgccacactgatatggctcagggtaggtatcccctcaaagacatctgaacttatgggaatattttttactctacagtcaaactgttctaaagaatggttaaggatattaaaccattctacgggaaaatctgtgttaatgatataaatagttaaatgttgattatgactaacaatagattttatagttgtcataacttgatcacgatattggaaatctgcacctaaaacaattgttttcttcatcgctacccctatctataaagcatatgcacagcatctatcaacaattttttagtgatataaccatttcgcaagagagttgctatcttctcaacattttccacatagctgtcataagtctctttttccatattattaattttttcaacagcttcttctagcgtttcaactgtaaatcctaatccgtgttgtttgataaagtctctacttgaaatatcatggttagcaataattggaagtccagcagccaagaaagtagataatttatacgaggcattcatcctcgaataacgacgctcgactaactcctctctatcttcactccaacacaggccaaatcctccccgcttagaaagacttagcatcaattctacatcatctttccatccctgagcatgaacatttgcctcagaattgagtctgcttccgtctccataatagatgagcgggatattttccttccagtcattgacaaagggaaagcgttgaatatcgcctgcaaaactaaggactttttgacattctggacgagggaggtctatattaactggatgatcccatacttcttgataaagaactttagaggtagtcatccctttttcaattagataatcatgcatcgcttttgtaggtagaataacaacatccgaacgattatacatgtcaattactctatctaataaataaaaattagactcaaacattaagggaacaatatcatgtacaaaagttataattctagcaccgtatgcctgtaatttatctagaaaaagttcatcaaattctgttgaattccatgtaggtacttgaaaaacaacaatatcccctctgcctaatcccgcaatgataccatccatcctagtacttctttcaccatgcgtttcagcatgatcattataaaagtagattcccatttcatcataaccaagttgacgtccgacatccttaactagtttttgtgatataagggcaatgctacgcggtgactgcccatatatacttgtaatatgtactcgcattttagttaatctctctttaaaactctctcttatccagaccatatcataccagttaaataatagttttattaacactcattgtactaaaatgatccaaagcttttttacattatttttgagtttatcgtaattgataaacttattttcagaaataaattccacttcttaattttatcatattttagcagaaaaacattgcttgtcacttgataaatatagatttacaaggctttttacaaacttctacaacaaaaaggcatatctctctaaaaatattaagagatatgccttttaccatgtcatttagtactttaagaattcaaagtaggtttagtctttatcttttttagatttttttcgtcccaaaagggttgcaccagtcattaaacctaaacctaaggcagtagcagttacagaataatcttggtcacccgtagaaggtaaggcagaatacaccttctcttttgatgaattagaagtcactgagcttgaagaacttgtggaagcgctggtacttgctgatgtcgatgcactcgttgagacgctggtgctggctgacgtcgtggcactcattgaagcgctagtgctggctgacatcgaggcacttgttgaagcacttgtgctggctgacatcgaggcacttgttgaagcacttgtgctggctgacattgacgcactcgttgaagcgctagtgctggctgacatcgaggcactggttgaagcactggtgctggctgacattgacgcactcgttgaagcgctggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgctgacgtggatgcactggtactggcacttgtggaagcgctagtacttgcacttgttgaggcgctcatacttgctgaggtggaagcactggtactggcactggttgaggcgctggtacttgcacttgttgaagcactcatacttgcacttgttgaagcactggtgctggctgacgtcgacgcactcatggaagcgctggtacttgctgatgtcgaggcactcatggaagcgctggtacttgctgacgtcgacgcactcgtagaagcactttctgataaaagtttaatttcggcattcgcatctgagtcaccacttatattcgtatgcccataagaatatttagaaccatatgtttgatttatatcagaaacagttgaatacaatacaccactttgtttaggtattttgaccaaaacaacataagatgtagtggaagaaatagaatttgttttccaatctatggtaattttagaaccatcgttagtataactatactgggaagtcacatcttcaaactcaggcgaatcataattttgatccatactatctgtaagattttttgaattagtttttagaatctttacttccgcatttaataaattaactggtgaacctgatgttccatctgaaccgataatagtatatagattcccaagtcctgatgcgaaatacatttccttaccttcaggattaatttgagtaatataagtttctgtctgtctttcatcatcaagcttcatgatccgagatcttacatttgtcttaacattagtatgttctgtcactgaaggactattatactgaacacgttcctcaattgaagcaacttgattgttcaatgttgcagtaaagcactgcttatctgaagttgttttagaaattattctctggtcaggccaaactggcatattgactctagctttaatattattcaacgtagaagcataccttgtccaggtgtatgtaatattatgtgttaaaggactatatgacccagtcgctaataactgccccgtttcatccattatatcttgaacttttagaatagtaccaatcccttgtgtgtcaaggttatcagaaagctttacagtaaagacatctccctcgttaacagaagcgattgaaaaggcaaagttcaaaacaaggttttctgaactatctaatttaactgttccaggctcactaagagtgttatcttttaacgcaatattaactttctgcaactcgcttgatacatctttacctaacatttcagtatcagacacttcttctagtggtatcaagtccatctccgaactcaaagtcatcaagttcatactccttggctgaataactgattttaatctaattgtcggagttagactctcattcccagttttatcgcttgcaatcattacttgggatttctctggagttataagcgactcatttgacattttggaagtctgtaactccgattttggttttgtaatttcaattaggctagatactgaagcatttttaccagcatcagtaactaagctactttctgttactatctggtttgccgaaaacgactctcttcctttatcagttaaagaagcttgagtttcaagaatatttgaaacctcactaatacttgtagattttgaaacactttctgaggctgacgtgcttatcgattctgaagcacttgttaaagcagatgtacttacagattcacttacacttgttaaagttgaccctgacatagacatacttacagattcactagtacttgttgaggctgactctgacatagatacactattagaatcaataatgtttttcgatactgtcccatcttgatgattttgaacagtagttgttttaacagtcacttccgtttgttctgccagtgttggtacagaacttgattgttcttgaacaactggagtctcatctgcataaacacgactggttaaactcgctccacctaccagagctccagcagctagtattcctttgagataggtcaaatttcctgaagatagtcggtcttctttttcaacatcttgaatacacacatctgcttcaacagttgctctccctttaatcgctttaaatagattaaaatgcgacattactgttcttacccagtttttttctgatttatgcatcttgactctactcttagtatctacaactgttaactgcttgccaaaagtcttttgggacatgtttcctccatatataaatattttttatattttgttttggtttaaaaacataacagtaaaattaagtgattagaaatctatcttagttaaacacaaaaataatgataccgttaagcacgtagatacatcatttttatacagatataaaccttacaattgatttttagtatgatttcataagaatctcaactgatgcttaataaacctttatgaggttatcactaattatgactaaaataaatatactttaacccctcattttcccaaaaaggcatttaaaatatttattttttgagaattattattttataaggttaaaatatttgaaacattttatattattccttattatagtattaatgagtgaaaggagttgtgtaatatgatagaaaattttttagaaaaaaatattcttaataaagttaaattacttactttatgttatgataccccctcactatccttagataccgcctgtaaccgactccacttatcaccagttgagcttaaaaactattgtcataaattaaatgttttatttggtcataaactttctatccatatccaaaaaaaacggattttatgtaagctaaataaacttactcaggaagatgccttaaaaatagtttataatgagtcaaacactttacaacttcttaaatttttaattgatgactcgtctgataaaaaatctctagtagcttttggaaatgatctcttcttatctcgttcttctgtctatcgtctgcgagaaaatttaattcctttaattaaagatttaggattatctttatctaaaaataccattgtaggtgacgaatatcgcattagatatctcatcgcatacctcactactaaatttggtattaaaatttacgatctgtctgctctagatattaagattattcgacaatttttatttgagagtggtactaatataagacctactacgcacctttctgatatctttgttttttttgatacgcttttcattttaacctgaaaacgtcaccatcataaagttaaaattccaaactccaaacttttctcttctcttaaaaaaatctttatttatgaggagctgaatacatgtgtaaaaagtatcgttcaaccttacttcaatgttatttttaattcagaagacatggattatatttttcttatctatcttacaagcgctaactcttttgctgctcaaaagtggactgaaacacatgtcgatgaagtgttagctatttttaaaagtcttcctaaattccaaatgctactacaacctttgaaagaagctcttccatactctgacacctactacgatgagctagtgaaagtcactatttacttttctcgaaacttcatagttggtctgaatcaattaattcctgaaacacttagttttccttcaacattctatcctggaaataatcctaaactaatatccattatcgaaccaatagtcactcattggctaactgaaattggagaatcaaagttcaaaaaaacgcacttcttcttgctctgtgctcaccttgaaagagtaataaagaatagcatgcctcctataaatattgtgttgctgacaactgattttattaataatgaaattttaaaagactatattttgcaatccctttcaacagataaaattagatttcattcctattacttattgacagataatattagtcaaatatcgaccttaaaacccgatttaattatcactaatcgaaaactgtttacctatgttacaaaggaactagctacaaatagtttagtcgctcatattgattacaacgatacaccctctcaaatcagtaatatccaaactattatttctaatattaaagaagaaaaatatcgaaaaatctttgataaaatataacatcacctactgtattcttttgatttcaattattaataaaacgactagagcacttcattaactactctagtcgttttattaattctgttcatcgtattaatcgattgcttttagttctaagataacatctcggatttgtgcagctagctcaaagtccaataattcagctgcttcttgcatttgctgttgaagagctttaatttcagcttgcctttcttttttagataaactactgtaatcgacaactttttcaggcttatcgctgtcattacttttagtaatagcaattaaatcacggatttcttttttaattgtttgtggcacaattccatgcttttcattataatccatttgtaaacgacgacggcgagcggtttcatccatagctctttgcatagaatctgttattttatcagcatacataataacatgaccattactgttacgtgctgcacgtccgattgtttggataagaccacgctcattacgaaggaaaccttccttatcagcatctaagattgcaacaagggaaacctcaggaacatctattccttcacgtaagagattaataccaattaaaacatcaaacacaccaagtcgtaaatcacgaataatctctgtacgttctaaggttttaatatcgctgtgcatatacttaactttaactcccatttctttgagataatctgttaagtcttctgccatacgctttgtcaatgttgtaataaaggtacgctcacctttttcagtcctcaaattgatttcaccaagcaagtcatccatctgccccatacttggtctaacttcaacttctggatcaagaagtcctgttggccggataatttgctcaacaactgtatctgtttgctccatttcatagtctcctggcgttgcagatacatagacaatttgatggacatggctttcgaattcttcacgacgaagtggacggttatctaaggcagatggtaaacggaaaccgtaattaaccaacatttctttacgcgaacggtctccattatacatccctttgatttgccccattgtcatgtgactctcatcaatcataatcaaaaaatcttctgggaagaaatctaacaaagtaaaaggtggctcaccttcacttctaccatccatgtgacgtgagtagttctcaacaccatttgtatatcccatttcacgaagcatttcaatatcatattctgtcctttgtcgaatacgttgcgcttcaatcaatttcccttctttttcaaaaagttctacttgattttccatttcagcttgtatttttgaaatagcttcttccatatgttcatcatttgtcataaagtgtgttgctgggaaaatagctaaatgttccacttctcctagcacacgccctgttaacgattctatttctcttatacgatcaatttcatcaccaaaaaattcaattcgaaaggcatgctcatcacgactcgcaggaaaaacttctacaacatcgccacgaacgcgaaattttccacgttgaaaatcaatatcgttacgctcaaattgaatatcaacgagattgttcaataactgatcacgtgaaatttcttgacctggcctaaggctaacaacactgtctgcatactctttaggagaacctaaaccgtaaatacaagaaacagatgctacaacaataacgtcatttctttctaataacgaagaagtcgctgagtgacgtaatttgtcaatttcgtcattgactgaactatctttttcaatataagtatccgaagaaggcacataagcttctggttgataataatcataatatgaaacaaagtactctacggcattgtcaggaaaaaattctttaaactctccataaagttgacctgctaaggttttattatgtgcaatcaccaaggttggcttgttaacttgggcgataacttggctcattgtgtaggttttaccagtaccagtagcaccttttaaaatctgagctttttctcctccttcaatattgtcaaccaacgtttcaatagcttgaggttgatctcccgaagggctatatttggaaactaatttaaatcggttagtatcttttctatctatcatttctttacctcgattactttattttaacatagaaaaaagaaaaagactgagctgcaacactcaatctgtttcttcagtcttaattagccatagaaggtatataattgctgctaagagaacaaaaatagaaatcaaacttccttctattccgaatgcaccacctgatatccagtccggtgcgttttctttaacggtaaaatgcaaaagagatgctcctgctttctgaccacttacggcaataccatagagattaccttggctaaaattccaagctccatgtaaggctgcaacactccaaatattaccacttttaatcatatacaaggacattaaaactcccgaacatataatacttacaatagaaagaaaagtgacatgggcatttaccaagtgcaaaatgccaaataaagtggatgagacccctatggcaacagctaaatgaaaacgatgattaattagaggaagaagccaccctcgtgttagcaattcttccgtaccgctttgaataagccaaaaaggaaggagagttacaacatagaaaatcgttgccttagaaacatcatagctatgaaagtcaagtcctcccaatatataagcagtgatgacagaaattgaaaatagaataaaacctatactccagccttttataagtgaccacagagttcttttaaactttgtagaaaaccccaattctgaaaaaggtcttttttctacgaattttacccagataagcaaaaggaatgctgaaaaactaaaggttcctaattctccatagatattattaaataaattaataaactcaaaaaaagtataggaagaaaacttatagagtacagaagacactagaacaattcccacaccacctagagttagaccaacgaaaaaaaataggtataccataaaacaagcaaataacaataatagccatgacggccagtttttatagacagcgaactgactatttaaaatccttttattcataataatcctaaatcctttttgtgtgataacactagaacgattatatcataatactaactaaagatatatataaaattaacataacatacatgttacgttttctaacatagaaatgacattttgttgctctatcttatttattttgatataataaaacacatatttataaaaaggagatttacatgaagcacaagttaaaagcttttacgcttgctttactctcaatattctttgtgtttggtggaaaggtcagtgcagagactgtgaatattgtttctgatacagcatacgctccattcgaatttaaagattctgatcaaacttataaaggaatcgatgttgacatcgttaacgaagtcgctaagcgtgctggctggaatgttaacatgacgtacccaggttttgatgccgcagttaacgctgttcaatctggacaggcagacgcgctaatggccggaactactgttactgaagcacgtaaaaaagtctttaatttctcagatacttattacgatacttccgttattctttatactaaaaataataataaagtcacaaactacaaacaactaaaaggaaaagtagtcggtgtaaaaaatggaacagctgctcaaagcttcttagaggaaaataaatctaaatacggctataaagttaaaacatttgatacaagtgacctaatgaataacagccttgattctggttctatttacgccgctatggacgatcaaccagttgtgcaatttgcgataaatcaaggaaaagcttacgccattaacatggaaggcgaggcagttggtagctttgcatttgctgtcaaaaaaggtagtggacacgataacctaattaaagaatttaacacagcttttgcacaaatgaaatcagatggcacttataatgacatcatggataaatggcttgggaaagacgctacaaaaacaagcggcaaagcaacaggtaatgccaatgaaaaagcaactcctgtaaagccaagttataaaattgtttctgattcttcattcgcaccattcgaatatcaaaacggtaaagggaaatatactggttttgatatggaattaatcaagaaaattgctaaacagcaaggttttaaacttgatatctcaaatccaggttttgatgccgctttaaatgctgtccaatctggacaagctgacggtgttattgcaggagctacaatcacagaagcacgccaaaaaatctttgatttttctgatccttattacacatctagcgttatcttagcggttaaaaaaggaagcaatgtcaaatcataccaagatttaaaaggaaaaacagttggtgctaaaaatggtactgcctcatatacttggttatcagaccacgcagataagtacaactatcatgttaaagcatttgatgaagcatctacaatgtatgatagtatgaactcaggttcaattgatgctctaatggatgacgaagcagttcttgcttacgctattaatcaaggtcgtaaatttgaaacacctatcaaaggtgaaaaatcaggcgatatcggatttgcagtgaaaaaaggggcaaatccagaattaattaaaatgtttaacaacggtcttgcttcactcaaaaaatcgggtgagtacgataaacttgttaaaaaatacctttccacagccagcacctcttcaaacgataaagctgctaaacctgtagatgaatcaactattttagggttaatttctaataactacaaacaattgctatctggtattggaactactttaagtttaactcttatctcatttgcgattgctatggttattggtattatctttggtatgatgagcgtatcaccaagtaatactctccgcacaatttcaatgatttttgttgatattgtccgtggtattccactcatgattgtggccgcttttattttctggggtattcctaatttaatcgaaagcatcacaggtcaccaaagtccaattaatgacttcgttgctgctactatcgctctttctttaaatggtggtgcgtacattgctgaaattgtacgtggtggtattgaagctgttccttctggtcaaatggaagcaagtcgtagtttaggtatttcttacggcaaaactatgcaaaaggttatcttgcctcaagcagtacgccttatgttaccaaactttatcaaccaatttgtcatctcattaaaggatacaacaattgtatcagcaatcggacttgtggaactcttccaaactggtaaaatcataattgcacgtaactatcaatcattccgtatgtatgctatccttgcaattatgtatcttgtaatcattacccttctcacccgtctagcaaaacgtttagaaaagaggcttaaataatggcagaattaaaaattgatgtccaagatttacacaagtcgtatgggcaaaatgaagttttaaaaggtattgatgctaaattttatgaaggtgatgttgtttgtattattggaccttctggttcaggaaaatcaactttccttcgcacattgaacttacttgaatcaatcacaagtggaaaagttgttgtggacggctttgagttatcaaacccaaaaacagacatagacaaagcacgtgaaaatatcggaatggtatttcaacacttcaatcttttcccacatatgtcagttcttgaaaacatcacttttgctcctatagaacttggtaaagaatctaaagaagcagctgaaaagcatgggatggaattacttgaaaaagttggtttagccgataaagctaatgccaaaccagatagtttatctggaggacaaaaacaacgtgtagctatcgcaagaagcttagcgatgaatccagatatcttactttttgacgaaccaacttctgcacttgatccagaaatggttggagatgttctcaatgttatgaaagatttagctgaacaaggtatgactatgttaattgtgacacacgaaatgggatttgctcgtcaagttgccaatcgtgttatctttacagatggtggtcgtttcctcgaagatgggacacctgagcaaatctttgatacacctcaacacccacgtctccaagacttccttaataaagttttaaacgtttaataaaaaagatgacttcgtgtcatctttttttatatcctaatcacaaacaaattataataggataagttttcttctaaaattagcaaaacatcagctagaatgtttgaataatgttgcacaagggctttcagtatgataatatagcagtatgaaagactatattaacagaatattgcactttattaaagaacatatgacttatcatgtcaactttatagatgactttttagatattaaatgggaaaaggtgagtaacatccatttaaggttttggacaactattattgcttatttagttatttttatcttaagtatctctaccgtaattcttaaccttgtacttctttttcaaggattcttaacgcaaaaccctattatttacttactattttttataactttagtttgtgctttttattttgcttataaatttattacttatactccaaccattgtaaaaaatgctcttcagtatatcaaaaagctcaaaaacgtttaaaataataaagtaatctgtaccttaacactctatcaattatgttttagagtcttttttcataccaaaataactaaaaaggatagttacttaactatcctttttcttttgctaatttttcgcgttctaaacgaagtttacgattaggatttaatgtgttaaagagttcttctaatttttcagcattccagacatcggccgctgaaacaaaattcccatctttatcacgaaatgatatcggtttatctcccataaaaaacctccaatcaagtactgcattaatctacaaattcaaattcgaagttacctatacgaacaatatctccatccttagctccgcgctctcgaagggcttcatcaacgcccataccacgtaactgacgagcaaatttcattattgattcatcgcgttccatatttgtcataacaaagagtttttctagcttatcaccatacaatacccacgttgcatcatcatcacgtgtaatctcaaatggacgttcatcttcgttaaatccatagtatgcttcatcttcttgcatgtcagtttcgtcataaagaagaaactcttctgtattggctaataattcagccgtcgcatccataaggttttctagtccttgatgtgctaaacttgaaattggaaaaatcataggcatgtcatcaaactcatcatagtttgctgctaatttttctttgaatgctgccaaattctcttctgaatcaggcatgtccattttattggcaacaataatttgcggacgttccatcaatcgaagattgtaagtttccaactcattattaattgaaacatagtcatcgtaagggtctcgtccttcacttgccgacatatcaataacatgtagaataacacgtgtacgctcaatatgtctaagaaactgagttcctaatccgacaccttgactagccccttcaatcaaaccaggaagatcagccattgcaaagctatcacctgattttgtacgaaccatccctaaattagggacaattgtcgtaaaatgataggcaccaattttaggctttgctgctgaaacaacactaagtagcgtcgacttcccaactgatgggaaaccaacgagaccaacatcagccaaaatttttaattctaattgtaattcacgttcttcaccaggctccccattttcagcaatttcaggagctggattacgtggggttgcaaagcgaatatttccacgaccaccgcggccacctctggctacaacgaattcctgatcatgctccacaaggtcggtaataaccttacctgtagtagcatcacgaacagttgttccaggtggtaatgacacaataaggtcttctgcacctcgaccgtgcatacctttagtcatccctttttcaccagcttttgctttaaaattacggttatatcgaaaatccatcaaagttcgtaaaccttcgtttactttaaaaatgaccgatccgcctttaccgccatcaccgccccacgggcctccattggggacatatttctcacggcgaaaagcaaccatgccatcaccaccgcgacctgccttaacactaattttggcagtatctaaaaacatactcatttctaaaattcctattctttattctattcagtataaaaaaacgctttacagcgtttctcattacatgattgcactaatagcaccaaataccaaaccaccaactgttactagtaccatcaaaataacaacaaaaagagttagtttttcaaacccagttttttttcgttgtccgttatctccaaaagccactcatgtcacctcatttactgaatatatagttaagtctatattaacacgaaacgtcttatttcgcaaactacaaaccgttagcttaaatatatctttattaaatcaatatatctttattaaatcgcttccatatttccttgtgctttataagagtttatgataaattataaaaaatagtaaatttaaaggagctagtatggttttacaagatttcgacaaccttttaaaaaaatatgcccaattaattatttctaaaggtttaaatgtccaaaaagggcacactctcgctttaacaatcgatgtggaacaagtccacttagcaaggcttttaactgaagccgcttatgaaaagggagcaagtgaagttattgttgattatacagatgattttatcacgcgccagcgactacttcatgcttcagacgaagttctcacgaatgttccacagtataccgttgataaatctttagcactattaaataagaaggctagtcgattagttgtgaaatcttctaaccctaacgctttcgctactgttgatcctaaacgtttatctgaaacaactagagcaaccgctattgccttagaggaacaaagtagagcaatacaagctaataaagtatcttggaacgtggctgcagctgctggtagagaatgggctgcacttgtcttcccagaattaaaaacaagcgaccaacaagttgatgctctttgggataccattttcaaattaaatcgtatttatgaagatgatcctattgctgcttgggacgcacatgaagctaaattattagaaaaagctactagactaaatcaagaacaatttgatgctcttcattataccgcaccaggtacagatttaacgcttggtatgcctaaaaatcatatttgggaggcagccggtagtctcaacgctcagggagagacttttatcgctaatatgcctactgaagaaatcttttcagcacctgattaccgtcgtgcagatgggtatgtgacaagtacaaaacctctcagttatgctggcgttattatcgaaaatatgacatttacctttaaagacggtaaaattatcaatgtcactgcagaaaaagggcaagaaacagtccaacgcttaatcgaggaaaatgatggggcaagatcgcttggggaagttgcacttgtcccacataaaacaccaatttcactatctggactgattttctttaatactttattcgatgaaaatgcctctaatcacctcgctattggaactgcatatgccttcaatgtagaaggaggaacagaaatgacaagtcaagaattggatgaagctggtttaaatcgttcttcaacacatgttgattttatgattggttcagaacaaatggatattgatggtattcgtgcagatggaactgctgtcccaatctttagaaatggcgaatgggctatttaaatataaaaaggaggttagtcctcctttttatatttaataaagtttcattttcttattgtaaaaacttaatgataacagaataatccctcccgtagatgctattacagtatctgagtggctatctcctgttttaggaagttcctttttaggcttactgtggccttttttcccatcatttgcttttgaagatgatgattcatcgcgatccacttcttcttgatcactacttgctttactaaaattcttaatactatcttctgaaattaatacttttgttccactagaaatatccttattattgccaatttctgtcttcgttctaccatcaggcttgttctcttcactaggtgagggttgcgatggttctgttgtaggtggattagttgacggatttgtttctggttcacttgatgaactcgattcattttcagaagaagaaccagtactagactggtctagttcatctgatcttttctcctcagataaggtcgtagtcacgacactcgtgtcagtattcttatcacttgtatcagcataaccgattgatgaataagtagcacatgttaagacagtaagtgctaccatcgttaaaatcttatttttcactttcatattatttcctattttataattccttacatcttcattataatttattacaacataaaaatcgaaaatatgatactaaaaagtgaaaaataggaattattttacattacaatcaacttttctgattcttttttgttacaaagctaaaacaagctaataaaagggttactactaaaactggagataggcttgattctgtatcacctgttttaggaagtgctttttgatatgccattacggatggtttatttttaacagacgatttcatccattttttagagatagatacttgagtaacttgtgaattttcttctaaatttactaatgatgaatgagctttaaagagggagttagtaggctgtattaggccagtagatggtttcacttctttatctattattctttgccatttaacattaaaaccatgatgtttttcaaagaaagttgcaaatttaattaataccatatcatagtttgcacctgccattaacatcgtccctatgggtaaaccagactcagataagtaagtcgggatactgatagctgggagtcctgtcatattagcaatttgtgtaaaaggtgttctacgcaacataggctcccactggcgattaaagagagcaattctttcttcttggctcaagttttccatattataaatcgctcttttatcttcctctgttacatatggatctgtatttagaggggctaaacttgcggtcgttggcgataagaaaataggaaattgcttgtgaagcttctccattgccttacgataatcatccatatgtttttgggcttccataatagatttcttaagttcagccttatctgaattttgataaataacatgaactgcccaagtaataggatcaacgtcttctttagtaaaaccatgtttttttaagtctttttcaattgttgaaaaagctcctcccatgccaatagccaaggttgaataatcacgcattaatgctctaccatcaattggtaagtctatctctgttactttgaatccttgttttcttaagaatgtgacgttgtccataatagcgtttttagcatcttgactaacttctgttcccattggtgatttcaaagtataagcaattggtaaagattttaaatcattaactgatactagcgtttgatcgcttttctttagataagttaataatgtttctgcgtctctagatgacttagttaatggaaaatgaactgctgtactatacgaatctggcttttcattactcaccaatcctcttgttggttttaaacctaccaagcccgtccaagaagatggaatacggatagaaccaccagcatcactaccgctagcaattggcgtcattccgctagcaatggctgctgcacttccaccagaagagccaccagcattatgagcaagatcccaaggattatgcgttagaccgtataatttagaatctgttatattacgccacccatactctggaaagttcgtttgtcctaaaataataaatcctaaatctttatattttttgacatagctactgtcaaatgtgctaatttttccatctgcatagatcaagccattattggtttcaccacctttaatactgtgccctaaccccttgactaacaagggaacacctaaaaacggctgattggtatctttaagttttctagcctcttcaatagcttcttggcgtctagtagtaatgactgcatttaaagatgggttttctttagcaataatatcgtatgccatattaacgagttcctcactagtaacttgaccacttctcaccatgttggctaaatcttgaccatctttttgtttgtaagtctcttcagttaacttagtagaagtactctcaacgacaggacttgattgagttgtttttaaagcatctggagctgaaatatgatgaggcgtgtcaactgttgtaagcgccgcagaattatctggttttacttgacctattacagattgtcctgattctgatacaaattttgcggtaggattactgtcattagtttgaacgatagtatttgtagtaggaactactgaagcacttgtctcagtactattagcatagatactgctagtattcattgcagcagctaacgttaaaaccgtcaccgtattaagaataaagtatttacgtttcatttgatcttccaatctaaaaaagtatacgtttacattataatctaagtgttatcaaattgctaaaatattaactgttgttttatattattgcatatatttttctaatttttctatttcttttattgttagccgtctccattgtccactttctagctgtttatctaattgtagatttcccatccttagacgctttagctctaagacttccttaccacacgcagcaaccatacgtttaacttgatggaattttccttccttaatggtgattttaacaagactctgcttcttcacctgatttacttccacaatttctaataatgctggtaaacaagtaaaatctttcagaataatccctttatcaaatgccaaaatatcgtcttctgtcattatccctgagatttttacctcatagcatttatcaacgtgttttttaggtgataacattttatgcgctaattccccattattagttaataacaaaaggcctgttgtatcaatatctaaacgccccactgggaaaacagctttatctcgagcagttttgtctagcaaatctaacacggttttatgcgaaggatcatccgttgctgatataacacctttgggtttatgaagcatataataaacaaacttttcatatgacactagagttccattatatttaatctcatctctatattcatctacctgtacttttggagatgtctcgctattaccattaacactaatctgcttttttttcaatattaatttgacttgagtacgtgaaccaagtccgcattctactaaaaatttatcaagtctcatttagatgttataacctctttcgataatgatatattgtaaaggatttttccatactcatcctttattactacttttctagtaatactatcattaatatattctcctcgtcaatggaggtcttaatggttttcttaactttaaggaactatcccacataaaaaagatggaaatacatttccatcttttcttattaaaatgagacattatctggatctttgggtttaatacctgaatctagttgtattaaggtagcaatatcatcttcgtttaattgaaaatcaaaaatatcaaggtttgcttcaatatttttgggagtcgctgacttaggtaatggtaaaaagccattatcaagtgaccagcgaagagctacttgcgcaactgatttaccatatttttcagcaatagcttttatagattcattttcaaaaatagcacctgttccaaatggactgtaagcttctaataagatatcatttcctttacagaagcgaaccaaatcctcttgagcacaacctggtgctaggataatttgattaaccataggttttatttcggcagtttcaaataaagcctctaagtgatgtttcatgaaattcgaaacaccaatagcttttacctttccttctttataagcttcttccatcgctttccaagtgcctgcattcccagctttccacgcatcattttcacgaagagcttttggatttggccaatgaatcaaaagaagatcaatataatcaacacctaatttctgcagagattcatcaatagaagctttggctaaatgatagtcatgtttgtcattccaaatcttagttgtcaaaaagatactttctcttgccaaaccactgtctcttatagcacgtccaacactatgttcattaccataaatctgagcagtatcaatatgagtataaccaacttttaaagcatgagtcactgccttataagcttcttcaccttcagttagttgccatgtcccaaaaccaattttaggaatgttaagagtattcgataaagtatatgtttccataacaatctccttttctatgtgacaaaaatgaatttcatagtgaaaaacatctattttaaacatctaaatgatagtttgatatatggtattatcccctccttatgtaaaattatataactttcttcatcaaaaccctatcattttgttcattccctttatttttctgacagtcattagaattttgtagctctactttgctacgatatcgcctgctgagattttttctaaattgtgatatgatagcattaataacaggaggatctaaaatgacaaaagaagatatcaaaaaacaagttcgaagagcttttgattttcgtatggcgattcgtgtttataataataatgatattcctaaagaagatatggagtatattttagatactgcttggttgagtccttcttcagtcggtttagaaggctggcgatttttggtactagatagacaaacaattgcaaaatttcgagataaacttaaggaagttgcttggggagcacaatatcaactagatactgctagtcactttgttttactactagctgaaaaaggtgcttattataacgctgatagcatgattaacagtctcattcgacgtggtctaggtgatccagctgcccttgagagtaggatacctctctacaaatccttccaagaaaacgatatgaaaattgattctgaacgttctctttgggattggacagcaaaacaaacttatatcgcactcggtaatatgatgacggctgctgctatgatcggcgtagattcatgcccaattgaaggatttgactatgaaaaggtcaataatatccttagtaaagaaggattaatagacgataagaaagaagctatttcttgtatggtttcatttggttatcgtttgcgtgaacctaaacattcccgtgctaggaaagaacgccaagaagtcattacttgggttgagtaaatagacagcctaatttataatcaatatttttgaaaagacaattttattttgacataatacgtctaataaagaaataggagagagactatgccatttttacatacttgtattcgcgttaaagatttggacgcctcaattgctttttatcaagaagcacttggttttaaggaagttcgtcgtaatgactttcctgaaaatcaatttactttagtctatatggccctagaggacgaccctagttacgaattagagttaacctataactatgatcacgaagcttatgatttaggaaatgggtatggtcatattgctgttggtgtagacgatttggaaactacttatgatgcccatcagaaagcaggttactctgtaacaaaaatttctggattaccaggtaaacctaatatgttctactttattcaagatccagatggctataaaattgaagttattcgactcagtcaatttaaagctgactaataacatctcatcatattaagttaaggactgaggcaaaaacctagtcctttttatgattaccttataatctttctattttttcccatattatgttaaaatttaagcaagaatgatacggagaattacaaatggctttattatcagttattgtcccttgttataatgaacaagagactgtctcaacttttttaacagaaatcaaaaaagttgaatccgaaatggctcgttacacccattttgaatacattttcgtaaacgatggttctactgatcgtacactcgaacttcttaagaaagcagctaaacaatttgacaatgttcattacctttcattttcacgccattttggtaaagatgctgctttattggctggtttagaacatactactggtgattttatcactgttatggatgttgacttgcaagatccacccactttattaccagaaatgtacctaaaacttcaagaaggttatgatattgtcgctacaaggcgaaaagatcgtaaaggggagccgttgatacgctctctttttgccaagcttttttataaattaatcaatcaagtgtcagatactaaaatggttgatggtgcgcgtgattttcgtctcatgacaaaacaagttgttgacagtattctcgagctaaatgaagtgaatcgcttctcaaaagggattttttcctggattggatatgatgtcgcttatattagttatgagaatcgagaacgaattgcgggtaagacctcatggagtttctttaatctcttaaaatactctctagacggtttcatcaacttctcagaaattccattagctatagctacctggattggaacccttagttcagtactatcacttttagctatcatttttattataattcgaaaattactatttggggatcccgtttcaggttgggcaagcacagttaccattgtactttttatgggtggtattcagttattgtcgctaggaattataggcaaatacatctctaagattttcctagaaactaaaaaacgcccagtctatattgtcaaggaagagggatgaattgaaatctcttagctcacttagctaggagattttatcatagaaaaatattgtatagtaattattgcgaattttgcaaaaaaattatataataaaggagtttttcaaaaatagatggagtatttataatgtcaaaaaataataatgaccacactcaaaaatctgagaatggtatggtacgcggcctagaaaatcgtcacgtacagttaattgcgattgcagggacaatcggaactgggctttttcttggtgcaggtcgttcaattagcctgacgggtccttcaatagttcttgtctatgctatcactggcgctttcatgttcttcatgatgcgtgctattggagagatgctttatcaagatccaaatcagcatacttttattaatttcattaccaaatatttaggacccggttggggatttttctcaacactttcttattggatttccctaatatttatcggtatggcagagattacagccgtaggagagtatgttcaattttggttccctgaatggccatcctggattatccaaattgtttttttagctatcctaagttctatcaacttaattgctgtaaaagcattcggagaaaccgagttttggtttgctatgataaaagttattgcaattcttggtttaatagcaaccggtatctttatggtattgacaaactttgacaccggtcacggataccatgcttcaatctcaaatatcaccaatcattttgaatggttccctaaaggtaaattgaatttcttcatggctttccaaatggtattctttgcttatttagctattgaatttgtcggagtaacaacttctgaaacagctaatccacgtaaagttttaccaaaagcaatccaagaaattccgatgcgtattattttattctacgcaggttcattattagcaattatggccatcttcccatggcaacagttaccagttaatgagtcacctttcgttacagtattcaaactagctgggattaagtgggctgccgctttgattaactttgttgtcctaacgtctgcagcatctgctcttaattctactttgtactcaacagggcgtcatttattccaattggctaatgaatcaccaaatgctcttacaaaagcgttaaaattagaccaattatctcgtcaaagcgttccaagtcgagctattattgcatcagctgtaatcgttggagcttcagcacttatcagtgttttacctggtatttcagatgccttctccttaattactgcatcatcttctggtgtttacatttctatctatgttcttattatgattgcacattggaaatatcgtaaatcacctgattttatggaagatggttataaaatgcctgcctacaaaatcctttcaccaatcacacttctcttcttcctctttgtattcgtttctctcttcttgcaagattcaacatacatcggggctattggagcaaccatctggattattggatttggtttatatagtcacttcaaacataaatcacattaagtctatattattagtgaagttggtcaatcaacttcacttttttcgtccaaaaaaggttaggcaattgcctaaccttttgataatcatcgtgaattatagttttttaactgacgggcaatatcacggttttgctcacgacgtttgatagactctcgcttatcataatcatgttttccttttgccaaacccaatagaactttagcaaaaccatcttttaagtaaacttttagaggtaccagagtcataccagtccctttcagttcatttgatattttttcaatctcacgtttttttagtaataactttcgtgtacgatcaggatcttgattccatatgttaccttgatcatatggtgtaatatgaacattaatcaaccacgcttcaccattttttatttgtgcatatccatctttcaatgtaatacgcgctgcgcggacacttttgatttctgttcctgtcaaaacaattcctgcttctattgtttcaacgatagtatagtcgtgatgcgcttttttattttgtgctacaacgtttccttgacctttaaccatacttaacctttcttagatttccgtttctgacctttcttagcaacgcctttatagaaaggttttttcgtttttttcttggttgaacctgttgttctatcgtctttatgatgatgtgatttgctatccgagttccttttgggttttcgagatgcttttttcttagatgtatttttattcttattatcacgatcagaaattctatgctgatgttctcgtttagaacttctattaggacgaccctcacgcgaacttttacttaccttttcaacaatatcaaaatctgatggtaaataatcaaaatcgatatcaccagtttccttatcagaacgaatcaacttaaccttaatttgttgaccaacacggaaaactttcccagatttctcaccttgaagcgtcagcgtacgttcattaaagtgataatattcaggcaaggtcgttacgtgaatcaatccttcaatagtatttggtaattctacaaacataccaaatttaacaacgcttgcaaccacaccttcaaattcctcaccaacatattcttccatatattcggctttcttcattgcctctacaatacgttcagcatcaatggcacgtctctcaagactagacgtttgagttgcaatttctgggataaggttagcaaaatgatcagctttatccatcgctttatcatcataatcacgaatcatacgatgaactaacaagtctggataacgtcgaatggggctagtaaagtgagtgtaatattccgcagcaagtccataatgtccatggttgtgttcagaatatctagcttgttgcatcgagcgcaataacatcatagataacacttcacttcctggctgcccttgtacttttttcataaagtcctgtaaagcagattgggtgattttagttgctgttccttgaatctgaacaccgaaaacagaagcataatcgatgaatttttgtaatttttcagctttaggctcttcgtgtatacgataaataaatggcagttttagacgagcataatgttcagcaaccgtttcatttgccgccaacataaatgactcaatcatgcgttcagcaatgcctctgttgcgaataacaatatcaactggcattcccttatcattaaccataatttttgcttcagatgtgtcaaaattcagcgctccacgacgcgtacgcatagcttccaaagtatggtgtaaagtgaccatatgctgtactgaggacacaatagactcatattctgagcagatttcctcatcgccagcaataatatcatttacagcggtataagtcatacgataagtggtattaatcactgactgtgtaatttgatgattaacaactctcccattttggtcaatttccataatacaagactgcgttaaacgatcaagatttggatttaatgaacatataccgttagatagacgctctggtaacattggtacaacgcgatctgtgacatatacggacgtaccacgactaagtgcttcacgatttaaggcagagccttcagtaacgtagtatgatacatctgcgatatgaactccaagttcaaaatgaccattatccagtaatttaatatgcacagcatcgtctaaatctttggcgtccgctccatcaatagtgaaagtgacctcttgacgtaaatcaacacgcccaattaaatctttctccgttggagcatctgggatagcattggcttctgcaataacgtcctcaggaaattctgagacgatatccatactttccaagacttctaaaacatcaataccaacatctccttgatgtccaacgatatcacgaacacttgctacgaagtaatcatgtcctcgtgtcggatatttatcaatatctactttgataatttctgttccgtctaaaacgaccggttctttgcgtatataaatcttttgattgattttttgatttttcgatttgatatatcctgcgtatttagggcgctcatcgtctaagacaaacttaccaacaagcgtctttaaactacgttcaacaatattaacaacacgcgcttctgctgcagtcccgttaagacggtccgctggtttctttacaacagcttctaccgtgtcaccatcaatagcataagcaatatcgttttttccgataaacatatcatcttcgtcttggtcaatactaagaaaaccaaatcctgctttatttgctctaaaaagaccccttactgtgatttcctttttcttagcttctttcttttgaagagaaagacttccattatcgtcaaatcttaattgcctgtggctctccaaatttgagattgttttgattaattttggaaatgcttttgcgcctgccatatctagggcagcagctaaatcattaacgctggttttaccgtgttcttccaaatattttataattttttctttcattatttccttttctagtaactttagtcactttattattactctacaaccattctactaacaaaaagtgaggttgggctatcccccatcctcacttatctgtatttagctatcattaatgacttgataaaatagataatactaagccgattagtagccagaaaaagactaaaacacctgtaaaacgttgcataaaagcttcaaatcctcgagctttactacgttcaaaaagggcttcagaaccgctactatcaaaaacattactacttggattcttttgtggttgcatgaaaattgagataatcaataatactgataaaacaagtagaatggtgagtaataggttatacatgttaattcctccactatggtcaaagtacattctaacataaaacttattaagattcaatatgtagtgttacttttctctcctttgggcaatactttggaacctcgattttatcgggatgattacttttattcttactggttaaataattcttactaccacaagagctacactttaaattaattttaactctcacacaatttccttaactctaatatattttctaaaattaataaaacaccaaacaaaattagctaaaacgatgaagctagtcacaaagaaaacccatcggaatcctaaatgaatagaaactgctgaaccgacaaaaggacctaatacttgtcctaaattgctaaacatttggttataactgaaaatccttgataaaccttgtcttggagcaattttagtcaagattgaattaatactcggcatcaaggcacctgttccaaaaccatacaggaatctaataacccctagctgtaatgaagtctgtgccaatgaacataagacatacatgaggaaactatacagtagagctaataatagcaaacgatgattgcctatgcgatccccgattcttcctagctttggactactcagaatactagagaatcccataccagaaacaattaatccggaaacaaacatcaagttttcagtctgtcctaaatgacgaatgtaaagtgttaaaataggtgcaattgattgtgcagaaatttgaataatcatgcttgttacaaacagccctattaaaatttgtaagcttttaacgcttttgaacacttctgtagttggcatggtttcttcgttagaaatgggtttgaaatcttcctttaccataaaaatggtcattaaagtagatattaacaatatggttcccactaataaaaaaacttccctaataccaaaccactctgctaaaagtccccctaaaagtggaccaattaacatacctccagtcactcctgtcgctaaggttcctaaggcatatcctgattcctcttgaggagcttgacttgctatcaaagctgtagagttaggtacatagcctgcaaaaatgccgtttaatatacgtaaaatcagaagtcctgtaacactatgaatgaaagcaagacctcccatagtaaaagtcatcatcaaccctgctcttaccatcatcggttttctaccatatttatcagctaagcgcccccataatggggcaactaaagctgaagacaaggctgataaggatactgataggcctgcataccactctactttgttgctaggtgctcctaattgttctacatataataccataaaaggcataacaagtgaaaagcttgccccagtaaaaaaattaccgagccaagccacttttaaattttgcttccagttaaccgtttcaactgagataaaacatcatcttctttctaaacttttctaccactaactatcttagcagttttattgagatttaacatctatttgagatgttatttccattataatttcctttatgtaactaaacctatgttatcacatgcctctgttattataccacaattaaaattaactttttaaacggaaagtttttggagcaaatactacaactgctaaatagccaataattaaaataacaactataattcctaggcttactaataatattggcatcgttatagatttagtaaaggtaaatagcttatatcccatatagtatataataaaggttaaaatattatacatagcactctttgattttaatccttctgtaaaaggctgtaagaagaaataaagatacaaaaagtaaaaactaaataaaatcattgatatagcttgtgtaattactaatatgataatctgatcaatcttaggggtgaaaaaattaaaataataggttccaaaacatatgtttaaagctacaaaaatggggaaattaagttttatactataaaggaaacgtatttttaaggttgctaagatattttctctttcacgatagaaattatatcttaataatggacgatccaaatgatagaaacaaaattttgaataggattcaccgatatatattagatatcctggaactgcactcaaaaataggaattttgaaaaactatgctcattcatcggaatatttatcttttctttaaaaaatagcaggaaaaggagttctattccaaacagaacacttaaaacagctaaacgtaccaaaattttcctttgcaagtatatactcatccgttttaaaaagatagcgtttaaatatgaaatacctgataaattttcaaatagcaggggagaaagttcactgacatttatatccctatctttcatttcaatcccaagcagctctatattatcaatctttgcaattttctccttcatcgtctcatgcgttagggtaaggtaggtcaagtggttaagtttagaataagtttttaatcgatagtaactaactaaccatatgataagtcctgcaataccggtgtaccatgaaaaaaatggatatggagagaactgtttgccaagaagaaggaaaaagagagaaaggaagactcctataccaatccctaagtaaaataaaatatttagtaaagactctggattctcttggtctttacctctaccatataaaggtaaacagagcaccttgattccaaggcgactacctgctaaaaataaagcaaaagtcaaaccatgccaaaaagcaaagtgatttaaatggaaaaatatgccaaagctcaaacttctaaaaaatagttcactactggcttctaaaagttcagcggattggaaatacctcgatggctcaattctgaaaaggcgaatcatatgagtttgttgcatatcattaggttctataagttttatatagaaatttatgacaattaaaagagaggtaatcaccatcaatgttaaagttagggtaaaaccttcttgcggtaaaatatttaactgcttcatgccacttctaacaaaaaatgataaaacataacaatatagtacgtaacctatggaacgaccaaaacctcttaagaaaaagaaaatgatacgaataaatagtactacaccttttatatcatcggttttaaaccatcggttagggatttttcttcccaaccaggggattttctgaaggtaatataaaaaactattataagctctagcactatcaatctgtaatatagaccatattaatgctttacttgtcatattcatctcccttcaacacttgaagaagacgctcttcgaattgttcatgtttacgatcaatatctaatgtttggagttttcctttgtctaatacagccacaatatcacatagatcttctgctaaggccattatatgagttgataatataataatatgatcctcacttaattccaacaaaaggcgttttattgcaatacttgatacaacatcaactgcagtcagtggctcatctagtaaaattacttttggcttagaaatcatcaggcaaattaatgagagcttactcttcattccatcagaatatcctttgataattctatgacgctctgtttgtcctatttccataaaatctaaataatcatctattgtcattaaatcatctgaaggatgtaaatccatgtaaaattttacaaattcataccctgttaaaaattctggaaggtagttttcggaataaacaataccaatatccttatcggtaagaggatactcgtgattatccttcaataaacaaatggtcccgttgtcagctgcaagatccccataaagtatattaaataaagttgttttcccagcaccattcctacctaagacccctgttattttacctgaataaaatcggtaacttgctcctctcaagacctctgtttcctgaaaccgcttacgaatatctctaattactaactccataaaaactcctttgaaagtaaaccttttatatcattgtactattactgtggtttaatcgcaagttttttaaaactagtgtaataaagacaaaaaatggataaatacattatccatttagtagttctataaacgttgaagagcatccaatatttgctcttttaaagttattaaatcaccattattgtcaataataagactagcgaaactttttttatctgttaaaggcatttggtgtgaaagtcgtaattctgcttcttctcgactgtagttgttacgggccattaatcgttgtaattgtttttctttatcaacaaataccaaccaaatctcatcaaaccattttatatacttttcttcaatcaataaaggaatatccatgaaaaatatctcttctgtttgttttaattggtcgcgctgacatgctaactcttgacgaatgatactattttgtagcctagctgatgtcttcatattgtctggattagcaaaaatcatttgagaaagctttggtctatccaactcaccatcagcatcaagtatctcgggacccaaccattctaataaagcttggtaaagtttcccacccttagcttgcaatttatgaaccacttgatccgcatctatgactttaaaacctgattctcgtattatttttgttaccgttgactttccagaagctatccctcctgtcagtcctattatttttgtcataagcattgacaccgagggcaataatgcgtccctctccctcctacttttatcttcttaattaaacaaccacaccttggacacggttgcccagttttaccatagacctgtaaatacttttgcatcgtaccgtcctctccaagagcattcttatatgttctaatcgtggagccacctttttcgatgcctaaagttaaaatgcgaataatttccttgtgtaataagcttgtttcagattcggtcaattgattagccaaacgctgtgggtgaatttttgctgcccacaagacttcatctacgtaaatatttccaagtcctgctactaatctctgatctaatagtaaaggttttattggctttttggagtttgctaagccttttgaaaaaggctcaaattgaaatgtgtcagcagttggctcaggacctaattttttttgagtaaaataatctttgagagatgatttacgaaccaactcaaatgtcccaaatttacggacatcttggtaaaccaatgtgctgccattagtcaatttgaaataaaggtgaaaatgtttgttatctggtactttatttgggaagagtagatattttccttccatgcgtaaatgtgataccataaccatttcaccaaaatcaaaaagaagatacttccctcgtctcaatacctgttgaattgtttttcctggtagacttatcataaagtcattcaaatcagttttcaccattttagggactttaatcgttatagaagctatttcttgattaactacaagtctttctagtccttttctaacggtttctacttctggtaattctggcataaatatatagtctaaaaatcaatagtcattgcttagagcaataatttccaaacgttcttgatgtcacctgaccattcgatttctattttcctttcttattatcattttgagacaaaagctttaaaaattactcataaacttgcactcattagcattctttattattgccaagtactttttgacaataatgttcattataagtattgtaaaatgaatcttcacctaaatatttaaaaatctgtaaagctttcctcatatcttcttttcctgaagaagtatcaccaagttttaaatgatagtatccagttacatataagaaaacagttttttcatagaaattaacttcatcctgtaacaatgatctaaccttatcaattaagtagtggctatgctcaaagtaagagtgatcaatgctgatgattagacaattaattgctaattgtgtaactaggattttattggttttattttgttctgaataagcaaacgaattaaccatttctttggtcaataaaaataaagtattgtaattaatgagacgtgagcaatttcctaagagaataatttcataatatccccactgctccaccgtaaaaagatagtctgttaagcgtgctaattcttcttgattaggctctattgattgatcaattgaaaaaataagagccttaatcataatcttttcatagtctttatggttatgatcctctaagagagccactaatttagttacatttttttcagcacaatattttcttactcgatttaaaaggataaaaaaatgagtgtgcgccttagaatgaatcgacacaaattcatcaatagtgatgttgagtttgtctaaaatattaagcaaacgactacaagtaatttctgactctcctctctcaaaccttgagatttgtgacttggataggtgctcatctgctaaagaagaaatactaactttttttcctttacgtaatcttcttagtgtttttcctaattctttttccatttttcccactttcacaacaatttaaaagaccctttaaatccattatataatacaagtacaaaatagaaaatcagaaaggagatagtcatgaaaaaaattaacaaagctttgttgttcacattaatcatggatatcctaattatcgttggtggataaaactccccacaaatggttgttatggaatcccattttatttagtttataacaggagaactaatgaagattaaaaaaattattagtggccttgccgcagctttaattatcagttcactatcaactattaactatgaggttaaagctgatgacaccaccagtgagtatcactatatcagtaagcaaaataatgaagagcagcttattagttacatcaaggaacaacatcgtttgctcaatcaatttgttgttgataatgtcaactcattcactcaactaaatgctaatccaactattgaacagttaaatagagctataacattatttaaacaaaaagatgagcaattatttaaccaggtgaaagctggtcatctctctcccagtaactataatgctatcgttaatcaacgtaatgtcattaaccaaactgttcaaaatctgattgaccaaaatcataataagcttcagacaagtcaaaataaagcagctcagctcgtggggcaacgtaatcaggttgttaacaaaattcaagctattttagcaactgtaaactacaactctgtgaattctatacaagaagctgaaaatttatttcattcactcagaaatcaaattgaacctcttgtagctgaagttaataattacaaagctgctatggcaatccttcaacaagaagtagatgccctatcaacagcggctattgaaactgagacttctaaacttgctactctcaaagttagcgaaaatacttctgttcctgcaaacaaagtagaagaaaaaactactcaatcagaagcgtcaggcaataaacaagaagtaactaagagtgaggaaaaacaggctacctctgatgcaaaggcatcacagcctgagtcagctaatattgccgattacgatagtttaaaagaagttttacgaaataatattagcaaccaagtaccacacatcagtgttcaaatggagtttaaaactcaagaacaagttgacgaataccaaaaaaatctcggaagcatcatccgggaaattggagatacacttggaacagcaactgaattcaatgccaaaagtaacattagcacttatactcttggtggacaaatccaacgcattattgtaaaaagcgacatcacaatcacctatactcttaaaggtgacatggtaggattacataaagaatataaacagtttgtagattcttttgtcaaagaaaatattactaacaaaaatatcacaagtgattatgaaaaagctaaagtaattcatgaccacttggttaataattacacttacgcgactgaagaactggcaaccactcgtgaaactgctagtggtatcagtatccatgctcctgaagcactctacaaagataaacgtggtgtttgtcaagcctttgcagtaatgtttaaagatatggctgctactgctggcttatcagtatggtatgtaactggtcaagctggaggtggaaatcacgcttggaacattgttactattaatggcgttaaatattatgttgatacaacatgggataataatataaaaagcaataaatatttccttgttggtaaaacaataatggatgctgatcatcttttggatagtcaatacaatgcattagctaaagatattccagctgatcgccatcaaggtgcataactcaaaaattgtattgagcctggaaaggatatgaaatgtctaaaaagactgattcaaattatctacattccaattgttctgacaagaaaatttggagcgatgaggcgcctctgcaacaggagactatccctaaagacagagattgtgttatcaaacctgtcattactatgacagttgaacatgtggaaatcccattagatgaccaatcttagctctctcctaaaataaaaaggaacactgccatttttgacagtgttcctttttatttaaccaaagtggttttctcattactgatatgattcaaatcatctacaactaattgatcaatcgatttcatggtgtatttccaagcttgcagttgaacatgaaaaacagtctgttggtacatggtatcatgcatatcgtcaatgactttgaaataccttatataatctggtttaatcattaggaacagcatgatcatgagtggtcaaagagctaccagcaccatccagagcgatataaatatctttcatcatatagaagctatttgtataagtaaatctaacagtattgggctccccgcaatacaaaatcacttgggacagctgatccaaagagaacgtctgggtcttttcttctcgataacctattccaaagctcccacttgaagtacttactgaatctgttgcaacagaaaaacaatccctactactagaataatagcacctctaactaataaatgactcattccaacattaacatcttttaacatcatgttcctttcattattttttatttaggaattcgtcatactatattttctcatatttatctaacaaaaaactcgtaattctatataaatcatataaagttacgaactttatttagttaacaataaaataataacattttattcattaaaaaaacgaataacaaaagagccaaaaagctcttttaaactgacaaaaatgtcttagtaatgtgattagtctctcaatcttattacttagagtaaatcaagcaaaaatgttagaaaataaaaaatatatgacaaactattccaaacaatatgctcgccaatcgaataatgaatggattttgtatagtggtgcaaactagcgaaaatcaaacccataccaaaatagacaacaaagtcgacgacagatagaccatgtaagtgagaccagctaaatagtatagaagataagatcacaaccaagggaccactcagggagttcccaaatgttctcatgacaaacaacctgaacgttatctcttcttaaattggggcaataagacagatagtcaataataagacaactcgaaagtagtgattgacctgattcatatcagctattaatccctcctggttttgccttattgggaaaaatgtttttactagtagtgcccagcaaaataaaacgctaaaagcacctattgcaaatagccattttttgaggttagatgatgactcttggtagttactgattggctcagtttttgttagcacataactcaacagaatcatcattataagattaatgccaatccatatactccaactccactctaaccctattgatagtaaactaatcacccaatgcccaagcaattgttattattgtgttgttgcaactttggcaaagatgaatatagcaggatggaaaacagattgtttctgaaacttcaaaggtatcttcttatcacaagctattatttggttatctccataattaatctaaatggagcaatatatcgtttttctactaactgttgacaaataaaaaactcccctttaaagtctggtaacttttcgatttttaccaaaaacttaaggagagtgaggcaagaactaatagaatcttatttaaagttttatgattgggagaacagaacaactatcataattactgaaaaattatgaaaggcatggcaaacaacagatggtcaaatccgctctgttgaaaacaaattttaaatataattcatttcactttctaagtttattaaacatagagtgttcaggagaaatgatacgacctaatgataaaatcattcctatcgtataataaacaacgacaaggtgtaaataaaagtaaattaatatatctgatatacttgtcaaacatcctttcattataataaaagcaactaagataggaataagaatagtacacttaataaataaccaaaattgcttaacaacttgataccatgtgagtacttctgtcgtttgtctttgtttgaagacaaaaaccaatagatcaaagagaaaactccaacagataagtagtatatttttcattaatgttaaatcgtagaaactacctatactaaatagaatcactgcagaaataataacaatgcctaaaaatcttaatatattatgcatatcctcacctcctctactttataggtagcaaatataatcttgagtcatgtgctctcctttatttaagaaggggccaacaagcatgtttggctccctttaattaatttgtgaatataatctcaaaattatgactagttggttttatcctcgtgaattgctttttctgtgcgaatcaagtctcacggtgaacttatctaactcttccccactaacttgcggatctcaaaataaactcattaatactctttttcattatagccaaaatcagctaaatcaagctttttatcacgccagtttttcttgacttttacccaagtctctaggtaaactttatcacctaacataagttcaatatcacggcgcgccatttttcctattttcttgagcatagcaccttgttttccaatgataatgcctttttgactatcacgttcaaccatgatagttgcacgaatatgcactttatcagtttcttcatcacgtttcatggattcgacaacaacagctactgagtgaggaacctcttgttgcgttaaatgaagtaccttctcacgaaccatttctgatactaaaaatcgttccggatgatcagtaatctgatcttctgggaaatattggaaaccttcttcaagattatcagtcaataacttgattagggttggcacattatttccttgaagggcagaaattggcactacttctttaaaatccatttgactacggaagtcatcaatctgttccaaaagttggtctggatgaaccttatcaattttgttgattactaaaataacaggaatcttggcagccttaagacgttcaataatcatatcatcgcctttgcctcgcttttcatcggcaggaaccatgaaaagaactgtttcaacttcacgtaaagtactataagcagattcaaccataaaatcaccaagggcggtctttggtttatgaattcctggggtatcaatgaaaacaatttgctcagtttctgttgtataaatccccataattttattacgtgttgtttgagctttatcactcatgatagcaattttttgtcccataacatggtttaggaaggttgattttccaacatttggacgacctaaaattgctacaaatcctgacttaaatgtcatttcttttctttctccattcaatttattcgtaatacttctcatcataaaagtaaagcaagtatcttgggtataaaaataatcaatcccaccaatacggcaaataaggaaacaactaaaaccgctcctgctgccatatctttagcatttttagccagcatcgagaaatggtaattacttgccaaatcaactacattttcaatagctgaattgataatttcaaaagtaattaccaaaaaaatactcaataaaagaaataaccactccaccatagatacttggaaagtaagaccagcaagtattactaaaatggcagaaaccaaatgcttacgcatatttctttcttctttaaaagctgtaaaaatccctgtaacagcaaattccatgcttgatgttaaggtgcgatttttccattttttgtgattattgtcgtttaagtccataagcagttaaaatttcttcctgtaagctgaacatctctttttcttcttcgggtgtataatgatcataaccgttaatatgcaaaaaaccatgtacagctaaaaaacccatttcacgttcataagagtgaccgtactcttctgcttgttctttagctttatcaatagaaataaaaagttcaccaatataagaatcaaaatcttctagcatctcagcaagttcaggattttcagccagatcttcttcatcaaaagaaatatcaacctcaggcttatattctaaactgataacatcagtcggacgatcggtatctcgatactctaaattcaattcatggctacgttcattagtgacaaacgttacagccatttctttattctctttacctgttttttgtgctgcaaactctaacaaatcaagagtttgctttttgatatcttctgaaacttgtccagtttcatcaatcatttcaacgtacatcttatatagtaagaacgacccaaaacgtttagaaaagataaagtgtaatgcataattctaaataatcgacacatctactttcctaagtttttcacttttatctaaaactagttctcaaaataaaagtgcgttctcttccttccttcaagctattctttcacatcattataccataagagtattaaaaaagggagagaaagctaataatcactattacacacttataatccatttcaataaaattctgacttatgaattagtatttacttcaaaatacaaactttagagcgcctaacttacgtaaaactaattcctaaataaacaaagctacaaatgctataacgattatgacaaatttacatttagaatgtctctttatataaatagatttttgttactttttctcagatgctttatattcgtacacacctaaacaattattaaatttacgaattgttggaagtaaagagcgaagtgtgcctaactcaaatttgctcatctcatctgtaaagttaatcagatttatttgctttaatttagggtctaaatccacaatctcatgaccatctgtgataccaaactgaaattctgtatccatatactttactgtatcatgttgctttcctttattaatcatttccttatgacacaaatcaaattgtgccataaattggctaaatgaatttgtcaggatatgaagaaaagtctctacgtcatcttcttttagaaacattaaaacaccttctgacacgattagaaaaggggcattttggggatttacctcccgtgtccaagtttcatctagggctgattttgctatattagtaactctttcatgctcttcaaaaaataattttcttatctccataacctctggcaaatcaaggttataccacctaatttgtccattatcgactctttcaaaccttgtatcaagtccacaaccaattgaaaggatttgactatttggattttctctaataaattttttgatttctctatccataacgcgaattctagctaatgttgcataaaaagaagcttctgaattatcgaatttatcaaaatcatattctatctgttcaacaattgctaaggatttttgatcattaagtatcggatgtttagccatcgcatctttagccctaatatataaggtgattaataacgtttcagcaacgccgtgtaatgttatcttcattcatctactctcctttatgctattttacttagaaatttggatttctaaaactggatttctttaagtatatcattccaataccgtaagtaaagcatatccccaccatcaaatattccataattttctttttctgtacttcttatgctttctaaaaaaacagtcactaaattattgcaagctactgtttttctttttaataattataaaatatacaaatgagaactccttattttcttaacatttgtttctacaagaatgcctaacaacatatcaataaaagttagaagttctttaaagtcacacctagtatttcccatccttttaacgccccatttggaatgtttgtgaaaaatattcatctaaaattaattggtgttgttcatttacgatcgtaatatttttgacgtcttctttagaaaaatagtccaattgcaatgtttcctcattatgaaaaccttctatattaactggttttggacagcttacttcataaataaaaccgacggtttgtgctttatcgccattgggataagagtcttgaaagttagtataaacatttaacagtctgattggttccactctcaatccagtttcttcgaaaaattctcttttcaatgtatctactgatgactcacctaactccatacatccaccaataattccccaagaattcttatcagctcttaattggagtaagacacgtcccttaccatctgtcaaaataccaccagaatatgttaaaaagatagtctcatgtccaacttttgacctaatgtaggaaatataatcttgtttcattctatcaccttgtttaaactaatatgtacgtattgtagcataaaatatctccttttcaaatcactcatatacacttcttgaatattagaaccgttacctcttttattaacttactattaattattgactaaaaagagatagccctgtagaatggagacacatcaatattttacatttttaggagagcatttatggaccatttcacaaaactctggcaagatttctctaaacttccaaatgttgttgctatagcactcggaggctcacgctctggtgacagttttgaccaatcttccgattatgatttgtatgtttattgtgcagcaactcctgatatcactagtcgtaaacgtatccttaacaagcactgtcattacattgaacttaacaatcattactgggagcttgaagataatggtactttaaacgacggaactgatattgatattctctatcgtaacatagataactttttatcagacttagaagatgtcgttgaacaccacaattctcgaattggatacactacttgtttttggcataacctcatcaattgccaaatactctatgatcctgaaaatcaattacaatcactcaaagagagattcgaagtttcttatcccagtcagttacaaaaacaaattatcattcaaaatcgtaacttattaactggcaagcttccctcttacgataaacaaattataaaagcccttaaacgccaagactttgttagtactcaccatagaactactgctttcttagattcctactttgatattatttttgcacttaataagttgacacatcctggcgaaaaaagaatgatttcctatgctaagaagaatgctacattgcttcctaaacatttcgaagaaaatatcattaaactatgtcatcacaactccaacgaacacactgttaaagaaacattaaacgatataataatgcatctcgacgtcatgcttaaagaaaattttcaacactttataggttaagttgaagtacaccatcataaaaacgcctaaagcattaggcgttttttacatattgacacactctctaacaacgtctcctagtggcaaacatcagtccttatcagattgtagcttgtgactactttctgaatctgaataagcatttattatttcagcaacgacagggtgtcttacaacatcctttgctgataaatgaataaagtcaatctttttgatatttcgtaatttctcaacagcatcaatcaaaccagatttaacattctttggtaagtcaatttggctaacatcgccatttacaatcattttagaattgaagccaagacgtgttaggaacattttcatttgcattatagtggtgttttgcgcttcatctaatatgacaaatgcatcatctaaagtacgaccacgcatgtaagccaatggagcaatttcgatgatttcacgctccattaagcgacttgtttgctctttacctaaaatttgatatagggcatcataaactggtctcaaataaggatcaactttctctttgagatctccaggcaagaaaccaaggctttcaccagcttcaaccgctggtctcgttaagattattcgtttaacttgaccacgctttagtgccgttactgctagagtgactgctaaaaaagtttttcccgttccagcaggcccaataccaaaaacaacatcatgatttttaacgctatcaacgtatattttttgccctaaagtcttaacacggataggcttaccatagctatccttaataatttcttcctcataaagggcaacgaatttatcaattgaaccattttgtgccatggataaggctgttacaacatctgaagtattcacagtcatcccgcggttaacaagcactaataatgcttcaatggttaaccgagcggtttctactgcttcttcagagtcacctaatacctgaacacgttcagttctagcatgaatgataacatctaaattttcttcgattaattttaaatggcgctcattgctgccaaagagtgacatcatatcatctggatgttgtaaagtaatttcgatagagtattcttgcaaattattcttccttttcgtacagtaagtgactacattataacaaaatttcattttctttggtgattttagtcgttgtaaaactaaaaaatcgagaaaaacaagttttctcgattttattttacattataaaagatgagcttctcgaagtaattcttctaaataagttcctctaatttttttcatgcctactttacgcattaaggcaggtattggtaaatccatatcttcaacagatttcttatcattgagatagtataaagattgcaacaagacacgaatatcaaatgctgaattaaagacttctggaacaccacgttcaatatttaagaaagtataaacagcttccatagcagttctaatagaatattccgttgtaaatactgtatctctggatggagattctgcaaaattaccaatgaaggctaggttaacagatccttgtgggataacatctggtcggtcacctttaactcgaggcatgaaataactagtaatgtaaggcatataaacaggaactgtacttacatattgtttatcagataaatcatgaatcttcatttcaggaacacctaagtgatataaccactcttctgtgatttctcgaccagtacattcttcaattggttttttaatataattaccttccacatttgaatagagtccataaatccaaacaattgtttcattttccttttgctctttgaaatgcggttggcgatggatagcaaaactcatcatccaattagaatctgtaactgtaacaatgcctccggtatttactttaccatcatggaggtcacgatgtgttaaacgctctatataaggttcaatagctggatcttttattgttgcagtagcagaaacaaaccatgactcttttggaatatctttgtagaagactttaggatgtccaaattcatcagattgagcagctaagttttcccaaagattccaagaacctcccaaatcggtattaggtttagctacagtatcatgactaccatagttcgtactttcagtgatagaaccattcgttacaaaaacaaaatcatttggagtaagatcaattgtttttgcttcaccaccaactgtgagatgaatagcttttgcaagcttctgaccgttcttaaagtctacggagatattagttaccttgctatcaaattgaacatctacattatgagactctaaataactgatgattggtttcaccatagaatcatattgattatatttattaaattttaatgaagtgaaatcaggcagaccaccaatatgatggataaagcgcatagcatatcgacgcatttcaatcgctgaatgccatttctcaaaggcaaacatagtaccccaataagtccaaaaattactttcaaaaaattcttttgaaaaaacttcttcaatcgtcttagcacctaaagactcttcagtctccatgactagcttaactaactctttggaatgtgttccgagtgtaaaatcaccatcagattctaagcgattcccctgtttatgaatgaggcgacagttagatgaattgggatcatccttgtcaagccaataaaattcatctagataagaagcatctggaacttcgagagaggggatggaacggtacatatcccacatacattcgaagtgattttccatttcacgaccaccacgcgttacaaaaccgatatcaggtcgtttgacaccgtcaagtgatcctccagaaagaggtagttcttcaaaaatatgaatacgttgaccatccatttgaccgtcacgtattaaaaagacagcggcagctaatcctgctaaaccagaaccaacaatataagcggattttttatccacaccttcaggttttcgaggtcttgcaaaggcttcaaaatttccatttgtatatctcataaacaacctccctagggctatattttagatgactatattctactcctttgtgaaaacgattgccattaaaaaacctgcttttcagacagtcttagacaatgtgtccaatttctataacctaaaaaagagattgaaaatacaatctctatattattgttaatgattgagataatcttcccaaatatcatcaaaatctgttaaattaaaggaaaaactggcctcatcttctaaatagcgactaactgtttcaaaatccgaactatgttttggaaaagtggtttcatcaaaagcgtaatctgctaggattgctactggttcatttgattttggatttctttgtgtcatcaaccaactgtaaaatgattttctcaatgccagttctcctctagaaatgcatgtcttctggcactactcaaggcgtaacgagcagggttagtccgatagaatgcttgatgatagtcttctgctgggtaaaaagtatcagcaggctcaatgctggttacaattggtctatcaaatctacccgaagcttgtagcttatcttttgatttttgagcaatctgacgttgctcttcattctcataaaagatgacaggacgataattatccccacgatcttcaaactgaccaaaagcgtctgttggatctgtttgtgcccaatataactcaactaaatctgcataagagattttttcaggattaaaaataatttcaacagcttctgtatgtccagtagttttactacaaacttctttataagttggattctcaacatgtcctccagtgtatccagataaaacagattcaataccatctaattcttcaaatggttgtaccatacaccaaaaacaacctccagcaaaaatcgcacgttccatatcgttctccattctttttaatagatacattataacaaaaaaagccaaaatttcctctcagcttttttctataattagccattaattctagctataactaaaacgacctcgtgagaaaactttaaaagttcaaaagtttataataattctgtacctagctgatcttgtttgatctttttagctttcatgagtcctccaagtgcttttttaaactgacctttggaaattccaaaagtagctttaatttcctctggagaagatttatcatttaaagtcatgaatcctccgttactttctaaatacgttaaaatcatttgtgcgtcattttctaacatttcaaaagaacgaggctttaatgataaatttaaggttctatcaacttctctgaagccaataactcgtgcatccagcacttgccctaaacgaggttcactgtaacgttcactagggtgaataaagccgagcatattattttctggtagataaacaaaagttcctgacaattttaagcgataaacgattgctggccaattttgattttgcatattgttatatgcaggggttgccattcgttgaaacacttcaggatctgcagggagagcccagagacgatcttttttatcaacatctaagcaaacgtagaggcgatcaccttttttaggccaaagttctttcaattcaggaagaacatccaaagaaacaaccacttgcttatctggaagaccagtatcaagaaatactcccaagtctttacgtacctcagtaactgtcccccaaccataatgatctcgagtcgcaaatgtttctttagttgtaagacgtgctttttgttgcatatctgtataggcgaatcctttaaccatttcaccaatgtgatgctctccttctgactttgataatgcaaaggtaaagccatctttttggataaagtaaaaatctttgttttcatcagttactaagcctgttatgactgtcgctaataatgtattcatttttctccttttaaaaaggtaaccgacaaaccaaatccatctggttttgattctatcagttacctccataatcattttattacttgccaatcataataaagatagcaaacgttactattaaacttccaacaattctttttctttattagcagtcatctcatcaatatgttttacagcatcatcagtagccttttgaatatctttttcaagagatttcaagtcatcttctgtaatttctttattcttttcttgcttcttagcttcatccatagcatcacggcgaatattacggatagcaatcttagcattttctccgacttttttcacttctttagctaaatcacgacgtgtttcttctgtcaaagctggaataacaagacgaataactgaaccatcatttgcaggattaatacctaaatctgattcgttaatagcacgctcaatatctttgattgatgatttatcaaatggtgaaattaaaagaacacgagcttcaggtacagtaatagaagctaattggttaaggggggttggcgctccataatactcaacttgaatacgatcaagcaagctagcattagcacgtcctgcacgaatccctgcaaattctcttgataaactttggtgtgattgctcaaaacgctcttgagcttttgtaacgatttccttagtcatattttttatacactcctattcagatgctttgtttgaaacagttgttccgatttgttctccaagaacaacacgcttaatattaccagtctcattcatattgaaaacaacaaggtcaatatcattatccattgaaatagttgatgcggttgcatccatgatttttaaccctcgttttattacttcaacgtgagttaattcatcaaatttgacagcattggcatctttctttggatcagcattataaacaccatctactccatttttagccattaaaattgcttctgcctcaatctcagcagcacgaagcgctgctgttgtatcagttgagaaataaggcgaaccaatacccgctccaaagacaacaatacgattcttctctagatgacgtaaagcacgaccacgtacgtaaggctcagcaacagtttgcattggaatagctgtttgaactctagtatctaccccatattgttgaaggctatcagccattacaagagcattcattactgtccctaacatccctgtataatcagcttgaacacgatccatccctgcttctgctgcaggttctccacgccaaagattacctccaccaatgacaagcgctatttgaacacctgaattgtgtacttcggcaatttcttttgcaatagattgaacggtaggaatgtcaataccgacacccttatctcccgccaatgcttcaccagataacttaattaatatacgttgatatttaggttccactactatgttctccttattttgtctttattattttaccataaaaggcaaaattttaatagagcaatgacactagtaagttgatttctttatcaactcctaaaataagaaaaacataataattcagagattggtcaaacagttagtagaacacgctctcttcaagaattcattatcttctactaaataaccattttttatcagaaagacccggttacagatagcttgacaaattttagggtcatgagaaatcattataaaacttaattcataacggcgttttattttttgtaataaacgtagcattttaatttgagttactgggtctaatccacttaaggattcatcaaaaataataattttaggctttaagagtaaagctctagcgatacaaactctctgtagctgaccaccactaagttgtctagctttatattttagataagttccatctaaacccaccgcttctaatatttgacataattcaaaagttgttttttttccataaaaagcttcattcaaaatttcctcaatactaaaatatggattgaccgaactaagcgcatcttgaaaaacaaggataatctgcgccttaccatctttaggtgtgtaaatttttccttgaaaatatatcgaaccacaagtaggactatctagtcctataatgagtcgggcaaggctacttttaccactgccacttttacccattataccaattatttctcctcttttaagatgaaaatgacagtcctttaaaacctcttgtcgtccaaatgtttttccgacatgattacaaaccaacattaagaatatctccttcatactccatttgcactgtcagtgctttcgtatagttatgttgaggattgcttaaaatagcttgggtttgtccctgttcaacaacttctccctcacttataactaataattgtccccccaggtctctagctaactgataatcatgcgttacagtaatcaaggtttttccattattttgcaattcctgcaaaatagctgatatagtagaacaattatgacaatcaaccgctgaggtcggctcatctaatatgattacctgaggatcaagagataatatagtggctaacataattctttgtagcattcctccactaagctcaaaagggtatttttttaacagggatatcgcatcatctaaatttaaacgtttcatccattctaacgctttagataaggctactctctttgaacatttctcatgactaaggattgtttccaaaatatgcgcttcaattttttgaaaaggattaaacatagacatgggattttgcactaaataggcaatatctcgtccccttaatttctgccactgctttacagttagtttacctaaatcaactcccttaaaaaatatgtttcctctaactgtcataccttgtggaatgtgaccaaccaataattttgccaagagggttttccctgaaccactctcaccaataatagttagcgattctcccatatctattttacaactaaaatctcttagtacagggacctctcctatctgtaatgacaattttcttatttctaactgttccattgtcgtttccaatcttttttatctatggcatcgcctaaagtattaaaggaaaatactgttaaaaaaatcgcaattccaggagataacatcatccaagtagctgtcctaaaatatcctctagcatcgtgcaacatcattccccattctgtgacattaggttgcacaccaatccctaagaaagaaaagccagaaatcattaaaataatatttcctatattcataaggaccataacgaggattggctgatacacaaaaggaaaaatatgttttcttaaaatatgccagactgaaagtcccataatttgcgcatttatcacataaggctctttttttgcactcttaactaaattggtcattaatttagcatagtaaacccattccacaaagacaattgcaaaaattaaattccctagaccatgacctaagattcccacggttgcaagagagagcaaaaagctcggaaaagctaaaataatattagctatccataaaaagaggttttctaactttccttgataccaaccaacaataagacccacaaacataccaatcgttaattccaataagctaataataatagctaaaaacagtgaatatctagcaccataaagcaagcgagataatacatctctacccaattggtcagtccctaacaaatgaacattattgggagccaataatttttgtgataaatctacgtattgtggatcaaagctagatagaataggggcaaaaatggcactaatcactaacaataccagtaagctactcgaaaaataaattctttttgatattatttctcccttgactttcgtaaccgaggatcaacccaattcataaaacactgtgtcataaaattattagctaaaaataaggttccaaaaattagcatacaagcttgtattactggaagatctgaagttcttagactggtcacaaataaacgtcctattccattccatgaaaaaatttcttcaacaataattgatcctgttaataagtaaacccaagtcaagctaagtgctgtcattatcgcaggtaaggcatttctaaggaggtgatgtgtgacaatataacgttcttttactcctcttaatcgggcattttccacatttaaacttctattttcttgactaatagcttttcgaataagggctatgtattgacctacggtagaaaaacttaaggtaatacttggcaaaattaaactttgtaaatcgttacctcctgaaacaggcagaagatttaattttgccgaaaatagcagcatcaacaagtaagcaacccaaaaatttggcatagacacactagaaaaactcaaaaatcgaatcaagtgatcactccgagcagattcatgtaagccagcccacacacctaacggggtagaaatggtaacaattagcaagaaggcactcgtgcctaaaaataaagtagccaaaaaccgttgtaaaaccaaatctaatactggcaacctgagcacataagaatatccaaaatctcctgttaatgctttttggaaccacagccagtactgcttccataatggcttatctaaacctaaatagtgctctgcttcttttagcgcttctggactaacacttatttttgataaacgaaggtaattttctgctgaattaactgttgatagtttgataagaataaatgttagaagtgatatgaaaaacaatgccaaaaaagctgacaatatttttttgatgatcgaactacttagatacattgtttttttctatatagcgtaatgggaatgaattttcttctggcgcaaaacgcatggttttaaaatcacctttcctataaacagaaatcaccgattgataagttaatgggatatatacagcctcatcatgcaataattcaagaaccttcttatagtctctatcaacattttcttccttaggatctactagagctgacttaataagtctatccatttcagttttagttgctagattttctaaagctatattttctggatgtccatgatctgccttggcagttaatgccgacatccaagcatgagggtcccatggtgctccccaagaataggttaacatcatatcaaaattaccctttttagcattagcccaataatcatcttcttccatagcaataagagaaacattaataccgattttacgccattctccttggaaataagttaccaggtctttatcagttgccttagtggcgatataaggaagacgtaaggttagagttttaccatctttttcacgaaccttatcttttcccatcttccaaccagcttgatccaatagctgatttgctttatcaacattatagctataaggatttaacttagcatctgagtgagatgttgattttgaaaaaatagtgtctgctggcttttctgttcctctaaaggtgttcttagcaatagaaaccttgtcaatagcatgattcattgcctgacgaacttttttatcttggaaaatactttccttagcatttagcaacaaaagtcttgttgacataggttgagaaatagctgtgacatatttcttgtccttcgtatattgggcaaaagtgtctaaaccaataatgccattcccatagatcaaatcaacgtcacctgattcgaatgctaaagcacgcgtctgagcatcgggtataacttttacggttacttcttttaattttggtttctttccccagtaattctcattacgtttgaaggtaatatattcattttgctttttacttttcacaacccattgacccgttccaattggtttttttacattcttcttagttgtatcatcacctttagggaaagcgctatcagataaaaagcgaattggtcgaatcatagagagatcatataaagtagcactataagcttgtttcagtttaatttcaaaagtactttgattcaaggcacgataattttccaattgattcgttaaattaaaccaattatgattacctctattagacttcgaaaaaatactatcaaaattacgtttgacattcgcagcattaaagttactgccatcagaatatttagcatttctcaatttaaaagtgtaggtttttccatcttgactaatgctccagcttttcgctaaagctggttcaattttcccattgtcaccatatcgtaccaacccctcataaaccatatcctggataacaaactgatcagggttatagcgatgcggattaacatcaccaaagtcttctccccaagcaagcgtgagtttatcactgtttagtttatgacttttgctatcctgtgaatggcatgcagtcagagtcaccatcaataaacaagtaatgctcaataatatgttacgtctcatttttaccaactttcttttaagtttagttaattatttttttaagcaaacttaattagatcattttagtaatgtcttgtcaagaatcttaaaataaaaaatctacaacgatacaaaatttacttattccctgcgaactcattttaatagattattgctaaagaataatcataatagtcacataccatatcaccaatttcatttttccttattctcatctgttacttaaaacacatcgcacattcattagtctttaagaaggttaatacagataaaaagctatttttcaaaagaaacacatataatatcctttgattattaaaatatatacttaactagttaagtatatagaataaataaaactaggaaggaattcctagttttttattgattaaagtgagttaggatcaactttgataccaacaccttgtgttgttgtaattgaaaggtttgtgatgtaagttccttttgcagtagctggtttagctttaacaataacatcattaaatgctttgaagttatcaactaatttagcatcatcaaatgaaactttaccaataagggcttggacgttacctgctttatcagcacggtaagtaattttaccacctttagactcttcaactgctttagcaacgtccatagttactgtaccagttttagggtttggcatcaagttacgaggtccaaggacacgtccaagacgtccaacaagtgccatcatatctggtgttgcgataacaacatcaaagtcaagccatccaccttggattttagcaactaagtcatcttcaccgacaaagtctgcacctgctgctttagcttcttcagctttagcaccacgagcaaaaacaagaacacgtgaagttttaccagtacctgctggtaaaaccatagcaccacggatttgttggtcagcttttttaacgtcaatgttaaggttataagaaacttcaacagttgcatcaaatttagcaaagttagtttcttttgcaagagctacagcttcttctacgctgtatgctttagtgctatcaattttctcaagagcagcacgtaagtttttactttttttagccattttaaaattctccttgtaatgtggtcaatcgatttgatttaaaatctcccacgtcactcatcaaactacgatgaagtcttgcgggttatgtgggtgtttctgattagtcagtaacagtgaatcccatagaacgagcagtaccttcgatcatacgcattgcagactcaaggtttgcagcgtttaaatctggcattttagtttcagcaatttcttgtacttgcgcacgagtaattgttgcaactttagttttgttaggttcacctgatcctttttcaacacctgcagcttttttcaaaagaacagcagctggtggtgttttagtgatgaaatcaaatgatttgtcttcatatactgagataacaactggaataatcataccagcttgatcagctgtacgagcgttaaactctttagtgaatcccatgatgttgattcctgcttgaccaagtgctggtccaactggtggagctggagttgctttaccagcaggaatttgaagttttacaagtttttcaacttttttagccatttttaaaaatcctcctgttgtggttttggcggtaattagaaatttttacctcccacaggcatgtttataacataccttaccattatactataatcataaataaaagcaatagttttaagccattaatttcattatattttaaatttagtaatttctcaaagtaagttccgtctgccctccaaaaccggaagttagtgtgaaaaggatttttatggtggaattaagtctgagacgtttgggttagaaatgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatctaacctaatcaactaactgatacaacctaaacgtctcacactaacttcaaccatagcggaacttaatctgaaacgctttcagatgaggatgttttcttgtaccctttttttgcgatttttaactctgaaaacctatgaaatcaagtattataaaaaccaacggaacttagtctgagacggattttcgttggtttttattggtttttatcagactaaattccatttctactagaggtggaacttactttgagaatttagcatattttaaatttctttcccaattccttttacattattacaacaatacttgagattttgaatctcaagtattgttatttatttatcctcaattttcttagggataacaaaaagaattgataagatcgatagactacaaaaaactaggtttaaaattaatccacacaaagctgctttgtgaaaatctgcattaccagaaaaagcatgataaatcgcaattgaagttgctacaccaattgcaccacctagtgaacttgccattttgtaaattccagatgcagaacctactttttcattaggaatactagaaatagctgtatctgttgatggtgtcgcatagatccccaagcctgttccaaataaagcataaccaacaaagactaacacaagatacaaaggtccttgaatattgaccaaagtcattaaaaatatcccaacaaatgtactcatagctcccaaaagcattggcttacgggcaccaaaacgttgtaaaattttctcaccaactcggatagcaattagtacacaaaccaaatagcctaaagacatttcacctgcaacctttggtgttagctggcgaccttgttgcatgtaagtattaataacaatcagagttcctgcaactgcattcagtaagaaatttgatattgtcgcacctaagtaaaatcgattttcaaacagatgaaagtcaataaaactattagatttacgtgtttcaacataataaaacagaacaaatccaataagcatcactgtaaaaagactcaatggaataacgttcatcaatccatgttcctgagccatagatatcccaatatttaacgataacattgaaataataaaaataattaaaccaaggtaatcaaagtgagttttttgtccaacatttttactttctggggttcctaaaattaatagaaaactaactactgatgcgatgattgaaaagataaagacataacgccaacctagagtacttgccaccgctccaccaaaataagaacatagacctgagccaccccacgatccgattgaccagaaactaactgcacgttgtctatctttaccatcatagtacgttttaaccaaggccattgttgatggcataataaaagctgctgccaatccttgaaaaatacgtcccataataaatagcactgctccattagctaaaacaattagtagagaaccaataatatttaagcaaagaccaataaaagtaaatttaactcgaccaagtttatctgctaaaccaccagttacaacaataaataaacctgaaaacaatgccgtacttgagacaccaatatccattgcaccagatgaaatacctaatgatgactgaacatctggtcccatgtttaaaatagactgtgcaaataaccaaaatgatagtacagcgagtacaattcccaccaataatttgttatttcctttgaaattttcctttgtcgttaacatatgttatctattctccttctacaagcatagcaagcgctgctgttgccattgatttagcagataccatcaatgatgattctgcaatttggaattttggatgatgatgtgggtaatatggttgcccctcttcatgtgctccaacatagaagaagcaagctgggattgtttgagcataataggcaaaatcttcagacggcgtttgagggtcgcaatcaatgacatctaaaatttcttttatagcaacagattttaaactatttgcaactttctgtgtcacttcactgttattaactaaaacaggataatcattctgatagtctaactgataactaacaccataagtttgtgctattccatctagaatacgcttaaattcctcctcaacaacacctcgtgtctcttcagacatcacgcgcacatcaccttctaaggttacactatctttgatcacattagcagaacctttaccatcaaaagatccgatagtaactactgctgtgtcaaatggattaactcgacgactgacaatcgtttgcgctgccataacaaaactagaagctgcaacaattgtatcatttgcacgatgtggcatggaaccatgtccacccttaccttgcaaaataactttaaaagtggcacgccctgtttgaatgggacctgcgtgatattgtaccgttccctcttccatcgttgacataacatggataccaaggacagcatcaatgccatctaaacatcctgcttcaatcattgcttttgctccgcctggtggcacctcttcagccggttgatgtaagatacggatatgacctgaaaattctgattttaattcaatcaagctctcagccaaaatcaataaataagctgtatgggcatcatgtccacaagcatgcatgacgcccgctgtttttgaagcaaaagaaagccctgtctcttcctgaattggaagagcatcaaagtcggctctcaaagcaatgtgtttgatgggcttatctgtcgctttatcaccatagatatcaactacgacgccattcataccaccaaattgtgtctgaacatgacagtccttacctttataaaaatctgaaatataagctgctgtttttgtctctttaaatgataattcgggattttcatgtaaatagcgacgaatagcaaccatttgatcacatttttggtcaagtttttcaaataattgatgtcgcaaagatgcattggccatttgctttcctccttaaaatatgaacagttaaaataaggctattattctaacaatctgctcttatatagtctacttttgaaaataattttttacaaataaatttttttagatatttctataactaaatagttatgaatatatcatgttatactactaaattaaatagattgattttagctcaaaatgatagtaaacttatagccataacgtatcataacttattattaatctaaggatatcaaactggttataaagtcttgaaaaatcaacaaaaattaatgtatctagagagtatcgagctatactcaaacatcactaaagccgctgcacacctttttatttctcaaccttacctaagcaaagtgatcaagcaattagaaaatgagttagaaataaaactcatccagagccaaggacaccaaacctttttaacttatgctggacagagatatctattctacctaaaagaaattgatatgattgagcgtcaaatggccaaagaactatatctcatccgttctgataaaaaaggagaaatcacacttgggattaactctggcttagcaagttctattctggcaaatgtacttcccaaatttaacttggagcacccagaaatttctgtcaaattactcgaaaacaatcaaaatatttctgaacaattggtagcgagtggtgatattgacctagctgttgggatggctcctatcctttataaagatggaattgcatcaaccactatttaccgcgacgaattgtttttaatgatacctaccaccagccaactctacaacgctgaaaaacgtggacagattattccttttgaatatcctatttcagttctagacaatgaacctcttatcctaacaccattagagtacggaattggcaaaacaattgcacaattctatgagcttcatcacatgtcattaaatcagatgattacaactagtaccgttcctacagcagctagcctatctttgtcagggatgggagcaacatttgttccacaaactctcattcatcgctatttggataaagagtgcaatgtctaccattttcataagaataagttattttcagagtacattatgatttataaaaaagatgttgaattatctggaattgctctcctactttataaagcttttttaaccaagtagtttcgctaattctattgaaaatcagtttacttcttaccaaaatcggtataaaatagacctatgatatacaaaattattgcttctttatttcttgttttaatccctatattttcacaggttcttgtcaaaatatttaaacttaaaaaatttaacattatgtttccagatgttgcttttcctatttttgtttttttaattccattaatatcatctagtctgttaaaacaaaatcttttaccttactatctgattctcatttcattactggcaatcggaattacaataaagcttctacgaacaaagactcttttttcttataaacgttttttaaaattattttggagatctggctttattctaactttccttttttacctaggattattggttatcatctttatcaaagtacaataaaaagagttggataaattgaactgcaccccaaaagttagacaaaaaatctaacgattggggtgcttttctgatgaaattaagttatgaagataaactagaaatatacgagttaagaaagatcgggatgtcctggtctcagattagtcaacgatatgatgttcgtatctcgaatcttaaatacatgataaaactcatggatcggtatggtgtagaaatcgtcgaaaaaggtagaaatgagtattatccacctgaattaaagcaggaaatgatagataaagtcttgattcatggttgttctcaactctctgtttctcttgattatgctctctctaattgttctatactcacaaattggctttcccaatttaagaaaaatggttatactattgttgagaaaacaagagggagaccgagtaaaatgggacgtaagcgtaagaaaacttgggaagaaatgacagagctcgagcgacttcaggaagaaaatgagcgcttgagaacggagaatgcctttctaaaaaagttgagggatttgcgcttgagggacgaagccttacagagcgaacggcagaaacaattagagaaatggtcacaggaggattccgactagacctcttacttgagataactaagatagctcgtgcaacttactattatcaactaaagaaactgaataaaccaaataaagacaaagcaatcaaatctgacattcaatccatttatgatgaacatagaggaaactatggctatcgtcggatttatttagaactgcgaaatcgtggctttgtcatcaaccacaaaagggtgcaaggcttgatgaaaagtatgggcttgactgctcgtattcgtcgtaagcgcaagtatgcctcttacaaaggtgaggttggtaagaaggctgataacctgattcaacgccagtttgaggggtcgaagccctatgagaagtgctataccgatgtgacggagtttgctttacctgaagggaaactttatctatcgcctgttcttgatggctataacagtgagataattgattttaccctgtctcggtctcctgacttgaaacaggttcaaaccatgcttgagagggcttttcctgcggcttcatacagcgaaaccattctccacagcgaccaaggctggcagtaccagcacaagtcctaccatcaatttctggaggacaaaggcattcgtccttctatgtcacggaaggggaacagtcctgacaacggtatgatggaatctttctttgggattctaaaatctgagatgttctatggcttggagaagtcttacaaatcacttgatgaccttgagcaagctatcacagattacattttttactacaacaacaagcgaatcaaagcaaaactaaaaggacttagtcctgtgcaatacagaactaaatccttcacttaaaataaattgtccaacttttgggggtcagtacaaaatttccaactctttttactttaggtttagaggataaagccctctaacagcattacaggcgtatatagcatcggctgattctaaatcttttaaagttagtggtgcttcaattactttttggtttttaaggagatgacgacgataaatcccattcaaccctccttctgataaatctggggttaaaaaccttccatttttttctaaaacaatattcccaatacttgtttccaatagcaacccctcaggagatacaaatatcttttcattctgaccttcaataatatgtgggcgataagaagttttaaaataagtaaacggggataatttaatagggtagtcttgtacgaccacctctgccgttaaaaacttttttgataaattcactagttgttttacctcaaacgttaccttaccagttttatcaagcattattttcaagcggtaatccttctcatctagctgatgaaggtattttttcagttccctttcgaatttacttttatcaaaagaataagcaaaataagacgctgattcaactaatctctcgacatgttgttgagagaaaagaagtttattttcagtcactcttcctgtagttattaattgaaattttggattgacacgtgttaaaacagctgatttttgacgggtttcttcatattcagaatctgtctggctctcccacgtaatacctccaccaacgccgtaataggcttgttgacctttcatttgtactgtgcgaataggaacgttaaaaatagcttgtccgtctggcatgcaaagtcctatcgtcccacaataaatacctcttggccgtttttccaactcattaataatagccattgttgatatcttaggagctccagtgatagatccacaaggatatagagcttgaaaaatagacataagtgtcacttctggcgataaaactccttcaatagttgatgtcatttgccacacagttgcatactgctccacttgacatagtttttttaccttaactgttccaacatcacagatacggcccatatcgtttcttaataaatcaacaatcatcatattttcagaacgatttttaggatcatttgccaaccaatctcgctccgccacatcttcttgataagtaggctttctagcgcttgttcccttcattggtctagttgttaagacttcatccttcttcttaaagaacaattccgggcttacagataaaatccttttatcgtcgtaggcaatataagcattatatcctgctccttgttctaccattaggcgttcataaacactaaagggatccgagcataattgttggctaagctctagtgtataatttacttgataagtatttccttgtctaatttgtcctttaatattagcaattgcctcttgatattcttgctcagaaacattagcagtccaattatctgctaatctaacattttcataacttaaaggaaaagcttcgttctcacaatctttatgtactgtaaaataagctagatgttctccagccaacttctgttgagaaactttaaaatgtgaatcaaaagcagcagatgcttcataagataaataaccaacaacataataattttgagattgataataatcaacttcttttatcacttctaagacttgttctaaagtatcagctattaattcttttgtaggatttttaaaacgatatctttttcctaattctttgaaatcaataacagtctcaatatgcattcgtaaccttcttcttcatctatttgcttcattataacataaaaaactaatccgacaatttcttgtcagattagttttttcttattcactcggagttggagtcattaaaacttttcgtggcttggttccttctgctggaccaataacccccgctgcttctaattcttccattagtcttgttgctctattgaaaccaacagacaatcggcgttgaatcattgaggcacttgctttttgcgtctctaaaacgagtcccttggcttcttcaaaaagaggatcactttcaggtactccgccgccaccaccagagccgttatctgtttcagatacttctccaggatcaaaggcatcatcatagtcagcctcggcttggtctttgataaaaccaacgatcctttcaacatcatcatctgaaataaaggaaccttgtagtcgtactggatgattctcatcaataggcttaaagagcatgtcaccccgtcccaagagcttttcagcaccattttcatcaaggatcgtacggctatcagtaccacttgaaacagcaaatgcaatacgcgacggaacatttgctttaatcaaaccagaaataacatctacggatggacgttgagttgcaagaatcatatggatacctgcagcacgtgctttttgccccaaacgaataatagcatcttcaacttctttactagcaaccatcatcaagtcagccaattcatctacaatgacaacgattaaaggcaaaggtatttgtttttgctcagaggaagcattaaactcttcaacctttgtattataacctgctatattacgcacaccaattttgctaaataactcgtatcgattttccatttcatcaacaactttttggagtgccttacttgctttacgcggattggttacaacagggattaataaatgtggaatatcattataaacagataattcaaccattttgggatcaatcatcataaacttaacttgatctggacgtgccttcatcaaaatacttgaaataattccattaactgccacagatttacctgaaccagttgaaccagctaccaaaagatgcggcattctagctaagttaaaactgcgagcattgccgttaacagcttttcctagtggtacttctaaaaggttttcaggattggcatcagattgttcccaaagttcgcggaaagaaaccgttgcaatttctgagttaggaacttcaatacctattaatgattttccaggaattggtgtttctatacgcacatcttttgctgcaagagcaagagctaggtcgtcagatagatttgaaatacgattcacacgaactccaactgctggtttaatttcatatttagtaactgatggtccaatttcagcacgttctacttttacatcgataccaaaacttctaaatgtttcttctaaaactctgatattctttcggactaaatccttttctttggattgatttttaggcttatctggtgcaaataaatctatcgttggtaatttataaaccagtgtcgttttaggtgtaaagtcgacattttctatatcactatcatctacatcatcatctaaatcataaaccatttcctcatcattttctctcatattaggaatcggcgaatcatagtcttctaaataaattgtcggctctactggtaaaggatcattttgaggcgatgtctcataagcaaggatctctggctcaaataccggagttgatgtttcacttacctcaggtggtagcgcatcatccaaattgtcctcagcttgatcctctagaatctcacccgtttcagggtctacattaaccgaagctaaataagcttcttcttcagctttttgacgctctatgcgctcttgttcagcgattgcttttttcatctctcgcttagcaaaacgctcctttttattttgctcgtgcttctctgccactttatttttaaaagctctaataaattcgacgatgtcataaacttccagagaactcattaaaaagagacccaaaatgatgaagagaacaccaatcatataggcaccaatattagaaaagagaaaagcaattggcttgtaaatcaaagcacccaacatacctccaccggcaaaaacagtgattttaaattgcattaaatcagacacaattaatcgagcagttgaacgcaaaatttctttatctttcaaaataggcattgagaaaaggtaagcatgccactcaatcaataatcctaaagaagctatcaaaaaacctgctactaagctatctttctttcgcaaccatttaaagaaataaaggtagattaaagttgccgcaataaataagtaagccaagctacctaccataaaacggatgacgttatagactgtaataccaaaaatacctaatctgataataccaaagaagagaataattgttaaaacaagagcagtaatcatcctttgaatagctctttgacgctctatttctgccttagtaggtcttctggttttctttccttttgtttttttcttatttgccataaataccatatttcaagtgaaatacttgttcctcactttctctatcaactcatgctatactattctatcataatttcaacaagtcccccaataggtttactatttacttttataaattatttaaaaatttatgataaaatataatcatcttaataacttaatcaaggagtatgtatgaaaaaaattatttatcttggtttagcctgtgtcagtatattaactttaagtggttgcgagtcaattgagcgttctctaaaaggagaccgttatgttgaccaaaaactagctgaaaactcttcaaaggaagctactgaacaactaaacaaaaaaactaagcaagccttaaaagctgataaaaaagcttttcctcaattggacaaggctgttgccaaaaacgaggcacaagtgcttataaaaacctctaaaggtgatataaatatcaagttatttccaaaatatgctcctttagctgttgaaaattttctaacacatgcaaaagaaggatactataatgggttaagtttccacagagttatcaaagattttatgatacaatctggtgaccctaatggagacgggaccggtggaaaatctatatggaatagcaaagataaaaagaaagattctggaaatggttttgttaatgaaatatccccttacctctacaatatcaggggaagtttagcaatggcaaatgctggagctgatactaatggcagccaattctttatcaatcaaagccagcaagatcattccaaacaactgtcagataaaaaagttcctaaggtgattattaaagcctattcagagggaggaaatccaagtttagatggtggttataccgtctttggacaagtaatctctggcatggaaactgtggataaaattgcttcggtagaagttacaaaatcagatcaaccaaaagaaaaaattactattacaagtatcaaagttattaaagactacaaatttaaataattctatcaaaaatgagactagaacattttctagtctcattttttaacaacactattgtttctttttaaacaaactttgtttaggagaaaataggaaagcaagtaaaaacataaaagtagatgttaaaacaatacttgatcctgcggcaatattaaatgtataaccgatatataaccccagaacagatgctactgctcctaatgcagatgataaaaacaacattgttctgagacttttaacataaagatatgctgttgcagctggtgtaattaaaagtgctacgatcaatattgttcccacactctgcatagctgttactgcaactaatgttaacaaaatcatcaataaataatgataaaaagaaactctcattcccattgattttgctaaaacaggatcaaaagaagtcaataataattctttaaagaagatagtaatcagagtcagtacaattaatcccacaataatagtcatatatttatcactatcttgtactgccaaaatattcccaaaaagaatatgaaagaggtcagttgtactattagcaagtccaattaaaatgatacctaaggctaaaaaggacgaaaaagtaattccaatagcagtatctccttttatgacactattttctttaatataagtaatgataatcgaagacaacaaaccaaagacaatagcacctataaaaaagttaatccctaaaataaaagatatagcaacacctggtagaacagcgtgagaaatagcatcacccatcaaagacattgagcgcaagataataaaacagcctactgcacccgctacaataccaatcacaattgcagttataaaagcattttgcaaaaaatgataagtcaataagccttcaaaaaatttcgtaaacattctagtctccttgtcctaacaaaatagcatcaccgtaagcagcacttaaattctcacgggtaaatgcctgatctattggtccacaagcaattagatgacggttcaaaataattacttgatcaaaataatgatcaactttactcaaatcgtgatggacgactaaaattaattttccggccttacttaatttttttagtaaattaactatgatttgttcactaatggaatcaatccctacaaacggctcatctaaaaaaatgtaatccgcttcttgaacgagacatcttgccataagcatacgttgaaattgtccacctgataaggcattaattggtctattttcaaaccctctcaaaccaacttgatcaatcactcgggatactttttcccagtcagtttttgatagtcgcttgaagaggcctcgttccttatataatcctaaagaaacgcattctccaacagttatagggaattggtaatcaatattagttttttgttcaacatatgctactctccccattaaaggtagcaaatctcccccaatccctgattctccagtagaatcaaccaaaccaagaagagctttcataagcgtagatttccccgccccattaggccctaaaataccaatgattccggagccttctaagcgtaaattaatatcttctagcactaaattattatcataacttacgcttaagtgtttactaataatcatttttcctccaaaagtagaatggagctggttataaaaccagactccacttctctgtatttattaaagctaagtcagtttttagattaggatttcgacattgttacaactcagccttaagcgagaatactacatcattgatttcattatgatttcaatgtcgattctcactcttattttgctaaaccttctgcaatcttatcaagattccatttcatcatagcgtagtagctgtcacccttttgaccttttttagcaattgagtctgtgaagatttctgcgtaaattgggatacctgattctcttgaaacagatttcataggacgcttgtcaacacttgattcaacgaataaagctgaaggtcttacttgttttaatttcttaactaagctagtaatttgatctggtgtaccttcttcttcagtgttaatttcccagatgtatgctgatggaactccataagcttttgagaaatatttaaagcaaccttcactagtaacaattaattttttattagctggaatggcattaaatttagattttgcttctttatccaatttttctaatttagctacataagcatctctgtttttctcataagtagctttgttttttggatctttagcaattaattgcttagcaatattttttgagtaaataataccattttcaaggttcaaccaagcatgtgggtcttctttaccttttccgctttgaccatttagataaataacatcaactccatcgctaaccgcaaagtaatctttgttttctttcttcttagcgttctttattaattttgtaaaccaagcattaccgcctgtttcaagattaattccgttgtaaaaaacaaggtctgcttgagttgttttttcaacgtctgctggtaatggctcatattcatgaggatctttaccaacaggtacaatactatgtaagtcgattttgttaccggctatattttttgttatatctgccaaaatagagttggttacaactacttttaatttttcgtttttggcttgatcctgcttgttagcacaggcacctaagcctaaaaatgctacaaaacatgatacaataactaaccactttttcatcaaaatgctccttttaaaattaatataagttatgtattaaattaagttaacttaattttgatattagcataacctattataaagtatttgtcaaatactttttcagtattttttgatataatggtcttagaaaaatagattttaagaagtataagaaagactgaatatgactccaaataaagcagattacctaaaatgcattcatgaattaggtgaaaaaaacaacaaaatttccaataagaaaatcgctgaaatgatgcaagtctcggctcctgccgtgtcagaaatgattaaaaaaatgataagtgaacaactgattgttaaagataaagatttaggatattatcttaccaaacaaggtttattagttgtttctgacctttaccgtaaacatcgtctagtagaggtatttttagttaaccatttgcactatactgctgatgatattcatgaagaagcggaagttttagaacatactgtatcaacaacttttgttgatcaattagaaaagttgttagactttccacaattttgtccacacggtgggactattcctaaaaagggagagtttttagtagaaattaaccaaatgacattggaccaaattagtcagcttggcacatatgttatcagtcgtgttcatgatgattttcagctactgaaatacctagaacaacaccgtttgcatatcaacgataccattgaattgacacaaattgacccttatgcaaaaacttatcacatcacctataacgatgaaaatctaacaatccctgagcgtatcgcaagtcaaatatatgtatctgctacataaataaaaaagtccgtgtattcattagatacacgggcttttttataatgctttcaaaaatgccattaatacttgggcagagcgtttaccagcttcaatgataaattcatcaaatgtgatattggcatcatgagctgcagtatcactcatagcacgtaccaccacaaagggctttcctgtagcttgagcagcttgggcaattgctgcaccttccatctcgacagctaaaacctgtggaaaatgccccttaataacatcaatcttttcctggccagcaataaaactatccccagttgcaattaaaccaactttactaatcatttcttctttagataaaactgcttcaaaagtggaaacaaaagtcttatccgaatgaaaataaagtggctgcattgacatttgtccatagtcataaccaaaggcggttaaatctacatcgtgataaactaatgtatctgcgacaacgacgtctcctacattcaatcctgttgctactgcaccagctgatcctgtattaataatagcatcaactttaaagctttctactaaaatagcaacactcatcgctgacatgactttcccaacaccagactgtactaaaacaagctcatgttcaccataacgtccactgtaatatacatttgataatactgtctcttgagatttatcctcaagattttccacaaggagttttaactcttcctccatggctgcaataattccaattttcatgatatttccttataatttaaaaattgcataaaacaagagagccaacaaaataagcaaaatgaataaaactaaattcaacttacgttgaaattcatttcgttttgcattctcaatccggcgactcttgtagatatgtttaccgttctcgtcagttagttgctccatgccatcttctgtagaaataattttagtttcttgatctaagattgtttgacctgaaactttttcacctcgatttgaacgttcaatcatatcatctgttaacaatggttttcccattaagaatgacctcccatttttaaaccgtaatattgtaaagcaatgatcgttttcgcatcttgaatcatgcctttttctaccatttgcatacaatcctcataacttaactctagaagctcaaggacctcatcatcatcttgtggcctaggattttcaactttttgtaaatcagtagctagatagaggacgattttctcattacaaaaaccaatagcagtgtagaaactataaagaatttcaagattccctgtgtagccagtctcttcttctaattcccgaagggcagcttcttccttagaacctgactcacccgtctcaagtttccctgctggaatttcgtaagaaataccttcaatagccttacgatactgtttcactaaaacaattttatgctcaggagttaccgccaaagtagcaacagctcctccatgaaaaacaagttcacgtttggattgtcccaatccatttggcaactctacatcatcaacagctactttgataatttgtccatcaaaaacagtttgacgattaattgttttttcttcaaaatccataagaacctcccaaataagtgttacttttgtgaaggatgatgtggttttttattggcatatccttctttattgacttgacgtcctcttccaatagctatgctatcaattggaacattatctgtgatggtagatccagctgctgttaaagcattatcaccaatttcaagtggtgcaatcagagtagaattacttccgataaagacattacttccgatttctgttttaaatttattttgtccatcataattgacagtaatcgtccctgcgccaaagttaacatcacaacctacctctgcattgccgatataagttaaatgacctgccttcgtattctcacctatttgagaaccctttacttcaacgaaattaccaatatgaacaccttttgcaagacttgttcctggtctaatatgcgcataagggcctacggttactccatcagaaataatggattcttcaaccatcgaattagtgatggtaacatcatttccgacttgagcatctactaaataactaccattggttaataaagtacctttaccaatcttcgtctgtccttttaaagtcacattaggctcaattacagattcttctccaatctcaacatcaatatcaatataagcggaatcaggattaaccactgtgaccccattaaccatatgttgacgtgcaattcggtgacgcatcactttttcagcagttgcaagtgctacacgatcattaactcctagactttcgtcaaagtcacgaagtttataggcacctacctttttacccgcttctttgaaaattccaataacatcagttagataatactctccttgagcgttatttgtattaatgtctttaagtgcttcaaatagactttgattatcaaaaacataagttccagtattaatctctttaacctgctgctcaaagtcattagcatccttttgttctacaattttagtaacttcatcatctgaattacggataatacgaccatatccaaatggatttgcagcatcggctgttaagattgttgcaacgtttttatgattgacatgaaaatcaattaagttttttaaactttctccagtaatcaggggtgtatcacctgcaataactagtgtatgtccttttgatgtcgctaattcttcttccgccatcattacagcatggccagttcctagctgttctgtttgcattacaaactctgatttgtcacctaaaacatcacgtacaagctccgccttatgtccaataacagtaacaattttacttggctcaatagcttgcacactacggaaaacatgctcaagcatggtaataccagatactttatgcataacttttggtaaatcagatttcatgcgagttcccttacccgcagctaaaataatggcataatttgacatattaattcctctatctctgaatataattcaacctattatatcataatgccttcaacttatcactaatacccctttaaatccctattacaatagactttagctaaaatagcttacttcaattaggaataaaatagctaccttttggtagctattcaatacatgaaatccgttaattttttcttctctgtttgcaatcagtatttttataaatctatcattgcaatgctcagatggtaaaaacgattagtttaactctgttgaaatttgccacatcacaccaaattggtctactaagtttgcgtaagcaggactccagaaagtttcttgtaactctaactgaacttcttgtgcactcttctttaatttttcataaatttcacgcgcctcctctacgctacccacaataatagcggctgtaacatttttaccagcttgatacacgaaatctggattttcatccgagatttgaagacgaatgccatcaaaaataagctgagcattaatgattaaatccttgcggtcttcaagacagttggggtccatctcttcccatgtcatcatattcactaaatccgcttgaaagacatctttataaaaatcaaccgcttgtcgcccatttccatttgttacgatgtatgtttctagtgctttaaccataagttctcctttttattttacttcacggattgcaaagtaattattgtcattatcggaaaaattaaaaactctcatactccccatatcaacaataggatttgtcataacctcatttgctgttaattcttgatatgtactgtcaatatcagtagtttcaaataaaatagagggagttgctaaatctagctcaggactcatttgagctataattgctttgtcatgtaagacgaagctaacttcactatccaacttcggtgcaactatataggttacataatctccttgtgtctgtttttcaacacgctcaaaacccaccttgtttttccaaaaatctgctgatgcttcaacattgctaacgtagagcattacctgtccaattgatgaaatcattttattatctcactttcggttttattactaattagtataacatacagtatttaaaataagtaaaaaatgactcaaaagagtcatttacttatttcgttaccatatctagaactttcatcaccgttctactatgttctaaagcttgagcagcacgcttaaaatctaaattgctaataataccttcaaaaataacaaattcatcgtgcatgcggtgcctatcaccatttaattgataaacatgactttcttgtccattcatagttaatgaaattttaggcatagtattagttggccctaaaatcgctatagaccccttatcaccttgaatagtagattttacttctgcactacaatcttttgctccaatacagactgttttaaagtgcccatagtctaggactagaactcctgaagtatcaataccacgctctatatttggtaaatactgtgctgttataggttctccaaaaagtccaattactaaatgtaaattataaatattaaggtctctcaacgcacctccacccatttcaggattgaaagctggtgctatttccccacgtttaaaggcatcataacgcgatgaatattgggaataattacattctacaattttaatatctccaaggttgcttaaatgttcttttacaaggtcaaaattaggtaaatattgatttgtaattgcttcgagtaatattagttgcctagtattggcaatagatacaagttcttctaattgacttgcttctaatgtaaatggcttctcacaaatgacatgttttcctgccaagagtgcctccttagcatagtcaaaatgcaagtgattcggcagtccaatatagactgtgtcaatctcctcattgtccaagacagccttatattcactcgtagctagagacatgttatattccttagctagatctttagctgtctccaaacttctaactgttgataagatagcaactagatcaataccttcaattttctgcaagacaggcaaaacttccttaacaatcatacctgtccccaaaaccgctaatttcattcgttaatctcctttgggtaaaccacttggaattcctctaaaactatcctagagtcctcactaaacattaaaccaaactcctcaaaataaggtttaaagaaatcaatgtgagcttttctccaccattctaaagttttatctccttctccttctttaaaagcatggtctgcagagacatctttaaaagggacaatatcaactttagttatttcaataatacagatagcttcatcattgctatccaaaataatatcatatgaaccaacttgtgtaacccttcctcatctaattcatataaatcataggcagaggccgttgcagtttttgtcccatctacaactaactttgccagaagatctggttctgctccaaattgccatgcgtctatctcatcaccgattgaaggattcaaagatttaaacttattccataattcttgtgccttcatattacctccgaagcaattcccacaacaaacttaactgcgttactcatttttctttgtcttttaaatccttctttaacatctaaaatataaacagtttgaccaatccaaacacgtaaataaacagattttattaaaatatcacctgatattcctttaacttcccgctcagtaccatcagatgcttcaaattccgtacgtaataaccaagtattaccacaaccaaattcaatctattttctcatttcaaactccagccaccatcaattttgacaatttcaccttgcattgatctcgcttttcctgaagcaagaaatccagttaattcagcaacttcacttggtttagtccaacgaccaattggcgtctcactagctacccattctgctaatccaccaggttcaaaatcactagcagtcatagcagtttgtacagcacctggcgctataccaaaaatttgaatacaatcttttgcgtaatccaaagccaattgacgtgtgaatcccgcaagggcatgtttagaactagtatatgcagctccaccgccacccgctataaaacttgctattgagcacatattgataataatacctgacttcttttccaccatacgtctaagataatgacgtgttagcctaacagtcacgaaaaaattaatatcaaataggtgttccagttcttcatcacttacttctagaagtggcttgtaggcatctagaatacctgcagtattacacaaaatatcaacagtcggtaccattgtgaatagtggggataaatcagaggataaatccaactttataaagttaaaattaccatttaagttcggtttatccgacttatccacaccatatacttgatacccttgtttcaaaaaatattgagcctgtgcataaccaattccactagcacagcccgtcactaaaacaactttagtcattgacctcgatccaatcctctgctaaaacatcacatggtgttggtgcccacatggaaaaaccttcaccttcaccagtaacattaataagaaaataaggtgtagcctgtagtactttcccattaacttcaagggtatcaaataactgaacataattttcagcgcccccccaacctgtacgtacatattttttctttgcttttaaacctggtaaaatttcttcaaatgtcatattgttctcctttattgtctttaaccattgatatatcaaggtttattgcttatttaaaatcataatttaaagtttcttcgccttttagttcatctaaaggctactattgttttcataggataaaatagtttctggtcatccattattagtaaataatatttcgtctttttcttgttggtcaagaacattatttttgttcttactccttcaattcccacaataaagttatctgcttgctccgtcaacaaaacaggtccattttccactaattcataagaaatacttagttgatttagcacagctataactttttcaaaatcattcgtaattttctccattcttccatagagttagcataactatttgtagactagagaacctaaaattgatacactgtttttcactcaaaaaattttaccttcataatcttcattatacctataacaattttcttttacaaatttgttccccttaaaggaaattgtttttcaaaataggatgtttatactattgtattatcggatgctttatctcgctagtgcaaaatcttctcataacacatttcttccttttcaaaataagtttttgatttacccttaaaagaaaaaccaaacctatcgtaaaatttccttgcgcgtgtattttctgtaaatacccaaagtatcactttattataacctgcttgttgtatctctgatagtacatgattcatcatttgagacccataaccttttccccaaccttctttaagactatgtatacaaatgagttctgcataatcaagcataccatcttctctacttttatcccaccaagccatacaatgaggattgctatctacttccaatatataccccttaccaacctccttgtgtagtagctgttgatacattgttatggcaggttctatttccgtagttttttgaatgatatcctcaggtagtatcttaccaaaagcagctttccagctctccgtttgaatataagctaaattgacttcatctcctaatcttgctctcctgattatgcaagccataactaaaatcctttcaaaaattattattaactgcctgataactactccaattataccattttcgtgatattaatttttattttgaacagttctggttctcatttatcattatatttctaaaattttagatggttttaaacattaacctcagattaggccaattattgataatcactaaaagagcgtagataattacgctcttttagtgattattttatatatatgaatcgctataacttctaagtaacacttgtttcaaaatccttcatttgtttctctctcgtaatatgcccccaaaccatttttttatttttatagccaataacacttgcaaccttaacaaaagttaatacaggatgtaggataagatacctaaaaacagcaatataaaatactttaacaatatctaaaattcctattactagttgctgagaataaatacggtgtaagaaagagcttaatgtaattaaaacacagtaaaagatataaaggctcaccaatgatataaagaatgggatgtttaattgattaaataataaggacaaaaatataatgacaataccaaaacattctataaaaggggtcagtaattcaaataaaatatagtaaatataagaaattgatcctacagctccaaagcgataattggcaaaaatacttttatatttttttaaacattggtacaagccaagataccatcggcgtctctgtttacgtaaatcccctaaattcgttggtgcttgactccaacaaacagcatctgtttcataacaaatacgataaggaatattattattacgacagaagaaatgtaatttcatcaccaactccatatcttctcctagagtctgggtgtcatatcctcccaccgctttaacaaggtctttcttaaaaagaccgaaagcccccgaaataattaaattagctcttaaatagtctaaaaagattcgagctcctaaaaatgatgaatcatactcaagtgcttgtgcacaaggaataattctccaaggcaaacgataagatgctactttcccctgctcaatcttaacaccttgggcaacttggacgagccctcccactgctataaccgtcggatctacctgtatggatttgctaatttgactcaaagaatctacctgcaacatagaatctgcatctagacatagaaaataatcgtaattagcagcattgatccccatatttaaggcatcccctttgccaccattttctttaacaatgagtgtcagtttaaccttaccaacctgtctctgaaagacatctttacaagtttgagtagcaataattgaatcaatcgtattcgagattttcattaatgcaaactcttccttgagaacatctgaagtattgtcactggaaccgtcatccacaacgataatttcatacgcttcataatcaaggtgcaataacgaatcaatcgaactcacaatggttgttgattcattataggctggtacaatagacttcctgcgaaacaaaatatggtacaatagttctatgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaactagcgaattattctggtaaaaagaaatgtcatgctatgaaggctcaggcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattttagtttcgcaggaagtctaataattgaaattggaattttttctttatttctagttaaactttttttgcgctcatttttttcatagagatgaacacctccaatgactaatgaaatcactaaaaagctggcataggcaatcaataatactaagaaaatgacttgagatacctttaggaaggtaaaaaataatgccatagaaaatcccctttatttgatatttatatcctttttccgaatacgaagccaactaagcttatctaatcgttgtcttaagatatagtgaatgttaaaaacaataattgctaagcaaatcaaaatgtaaaaatataaaatattatgtaccatatgttctctctctttctttagaccattctttcttaatactataataggagtcttttaaaaaggttttggtatcgggtctctcccaatttttcaaacgataatctgccatctttatcagtgtgttttctttgctattagcacctaatcctaaagcaatgctctcaatttctaactccttcacaccataatgtttaaagtaatcatcgtgaattttttgagatgatggatcagaaaaattcaacaactgccacggaattctgacctctataaagtcctttccaaacgaaatatctgtttgtgaatcaaatgttttttggtgcctatcagttgttcctgttttgagaagaccagtaggatgagttggtaagaacctctctgttgcttttactttttccatgtcttcaacaatctttgtatttctcaataccatatttatctgctcaaaattactactgttcttctttggtgggaaagcataaaaatctttaccgttaagctgtcgaagatagttcgcttttaaggcattatagcgctcttggacaaataattcagacttgccatttggatcaatagacaatacaaagtcactagatttagaaaatgtgaccttactaccattcatttttctactaccagattttggtgtaatatctattggtaataatcgtttttcttttagtttttcaggttttgttttaatcgcaaggtagagatagctttcatcactgctagcatataagtcatctcctgttgcactagtcatcagaggatgtttccactctcctttgcctcttttaccatcaacttgataatgatgttttgcgtttttaaagcctaataaaccataaccttgattaaatacttgtgcatccccccataggaattgactatgtttatttgtggcgaaagatgtattccacgcccttgcattccaatcgtcttgccatgcattgatagtcgctccaaaactaccggatgatataaaagattcataatcttctagtaaacgctgaccttgttctttttcattaatcggcagaggacgtttatcaatttctttttgggcaatacctctcgctgtcgaatagccataacccgtgactagaacagggattttgtgataagcatttagcagtttaacgtatccctgtgacaaagaaagttctttaatcttttgtctatcttctttactgatattctctttatcaaataatagataatccttgtatcgaggatggaaatcaatagctttatatgctgcaaacatacctgctttaacatttgaattagcttgaatattttctacatttagttgtacgtatttaggagcctgtgcctcaaatggttttcgataatgaaaagggtctgttgttggtgagtttgaaaaactaatcaaatgttgccaaccatatttagctgtctcataatgtgtcaattcatccattacttgagctagcatgacctcaaatggattagctgccacagaagttttaaaataacgtcctttatattgcgtttttttctcttgatgattagtataagcgacagtaccactattccaatcatcccctacgacataaccaagtacccaaggactaagatcataatgataatgacggctacccaaatcagtattccatacttgcttacgcccatggagaatatccacaacgccttttgcttctcgttttaaataccccctataattatcattaaaagctgttatagaagcattattgcgataagaatctatacgtattccttgcaacaaatacagtggcctctttgatgctttgttgtggtgatataaggcatcgtaaaatgcaacattcatcggtaccttgactcttacagtatttgcccccatgttggaaattaaatggaaccattcacgatacgttttttgagtaataggaaaatcgttgtgatgataacccgctaaggaagactcaacgtctactcctttaacaacaaaaggtttattggtgggcttgtgaagtacagtatcacctttaacaacaaagttagttcttgtattttcttttaataagccctttggtaaatacaaactaccatcaaagtaatacaaataataaatagagctaaacaaaatagttaaaagggctacaatacttagatattttttcataatgttctactccagtaaagtattagtatttttcgatggtgcactatattgatacaaggtctcaatatttctatccatccatctgccacgctttttgataaaatcttttaattgttctactgatttgtgataacttgtcacattgcgttcagtaggaatcaaataattccttggatcagtattctttaaatcaaagacatagccccattttttataatttcgatcaatagctggacctaaaaaatgccttgtctcgtctatgtaattagataaatattctgtcgctagaactccctttcgtaattctttatagcgatgaacaaccaggtctataaatgctttgtccttaatgagcatattgaaccacggtgcatccgtcaaggtaaaatctgcctcatcaacacgtccttcaatttgattatcaaaagcattattaaaatcccaaactactagttttgctctatcacgaagatctttatatagataggttgaaaatttacccgcatccacatttctaaaaaattcattgatgacaaaataatttgcaaatgattctctatcaatatatttaggatattgtgaaaaatcataagaataaaggactttttcaatatgattgatgtccttattaataaactctaattgttttgatgtcaatctttgtttacctggatatttcacatcaagagctgagataccagactggtgtgtataatgtacatagttatctaacttttgctttgccttatgttcacgatcccaagcaacgatataaggtgttttatgcaactttttatcacttttttcaatgggaactcgttgctcaccttgttcgatattctcaactgctagatatactccctgatactcaccattgacaaataactcacagtagcgaacgtttggggcataggacataatctcaccagcaatattataactcagataatttcttaataatgttctgtctagaaagggaccatgcaatacccactccgattctttaggcattcctgctaatcgatgcttcttttcctttaacttattagtaacaaacttaactttcaatgacttcttatcaaagtaacgagaggtatttcctctatatgatattaacccttttgtcctaattctcggcttttctgataaatgatgtgatctacttggagaatcccgtaattcgatatcaacattaatattatccctagctttgacatattttccgccttcttttgtaacaagaggaataacttgttgctttgtatcaatgctgataatgggcaaatgggttttaaatcctgttaaatcactcttcgcatctacctgctttatacgatgatgatgtattctctcgatgtgatgcttaggaatccaaaaatagaaaaataagaatagaaaaagacctataagggttgtgccgtaaataaccttccctctcataagtctacccattgatttcgtcgctttggctaacaatgttgaaataatcaatatttcccaattggtacactttttcagttaactgattatctacatggagttgcttatcgtaatcttttctagagatttcgaaaatcatttcaatagtattagttgttgaatttttaacacgctgaacagcttttccgtcaaaatattggaagaaaattccttctaaatcaacttctagtgttctatcgcacttcacaatcaataacatacgattctcgtttttaacacgtcccataacccataataagataaagataacgctacttcctaatgcagctaccacatagtcaccgacaccacaacagataccaacaactatggtccaaaaaatataaactgtatctcttgaatcttttatggctgtcctaaaacgaacaactgacaaggcaccgaccatacccaatgacaaggctacattattaccaataacggtcattactgttgcagtcaagaccgtcaatgtcattaatgaaacattaaactttttactataggcagttccactatgcgtataagcataggaaacataaataactacactcaataaagctgctacaagaatatgtaaaatcatatcttgaaaacttaaatttccactttgctctagactatttcgtaataggtctttcatttttttgttatcctctcacatttaataataattaacgtatatactttttcactaaaaacgataatgtttactaacagctcttcctaaacaatacttactcgctgaaagttcacttctatctaccgaatctaagagttctttaatataagacaataaaaatccattatatttaacttctaaaataacaagataaggatctaataaataattttgatttaaatcctctgagaaaatatcataactagcctctgtacctattatatggtggtcaaaggtgattcggatattgttttccttagcaacaaaagcttttctttggtactcaataaccgttttaggttgataaagttgcgttgttatccttgaataacactccgcagcaaatgtatccggataatttaataaaacactattgttaccattaatcagcgcttgagcatctgtcttgcttaattttagagagcgctttttttgattagcaccttgtttttgtttcatttctaatttcgcaaaattgctttgactaccataattgcgcaaacgaatctttcttcgtatctcaacaccatcttccttttcttgccaatcaacatcttctaaagaatcaaagtatagcgaacggatagtatagccgtcgtctgaactatgcgaatcgagcgtcattacttgggaaaatttcttagataaaagatagtaatcttcaagtgatattaaatattttttttcctgtctaagaacttcgttcatcactcacctatgtttaattaaatattaatttatatataaatattaacaataaattaaacaaaaataaatatatcagaaattatacaccttgtcaacaggaaaatatataatgtatattttttttatacgaaggcatttcaaactttatttttatactataaatatgattgttacgctcatttaaacctagaagaaaaatgtatattttcaatccacagctgttataaaataatttttaaaaagtgtttatatcttagtttaatcacaccttactacaatctatatatcatttaaaaaaatctgatataaaaaaggctaaaactaagttttaacctttttgacatatctataaaattgaaatagtgctatccttcaaatttctctaaatcaaatgcttggcctttttgtttatctgacagcaccaaagaaaatactataccaatcaacattggaactagccaccccattgaaatagtatgaaaggggaggaatccaactaactgagttaatgttttttcttgccattgtcccgctagaacctcaacaaacgacactaaagtgacaagaccaattgtcaaagacattcccttttttgaaagcggcaaccacttattaatcaaaataattaagacaataacaataacaatcggatacaataaagttagcacaggaactgaaaaagtaattacagcatttaaaccaagattagcaattaaaaagccaatcaaagtaaaaacagtagcaaataatttataattcccaaaacgaaagttcttatcaaaaaattcagatactgacacaataagcccaactgttgttgtaaagcatgtcaatgttaccataatactcaagaaataacgaccaaaatttccaaataatttataagatgcttgtgataatacataagctcctttattaacatttgggtcagctaaaatatcagctgggacaggaaacttattccctaaaaaacctaagccaatatataaaatactaaatgctaaactagtaacaattccaacaatccaaatggttgataaatattcttttttagttttaaaaccaaactttttaagcgtttctgttgctactagacaaaaagcaactgctgcaagtgcatcaagtgtattatagcctgctaagacaccacttccaaacgcttttcctgcatagtcagcactcgccttagcactctccaagtttccataagcaatagctccaacaacaaccaaagagagaattaaaaaggcaaaaacaggcgttaagatttttccaacactatctaatataccatttggtctaatagcgagataataagctgcagcaaaaaaacaggctgtaaaacacaaaagagcaatcggactatgccctacaattggagcaaccccaatttcaaaagaaaccgttgctgttctaggaatagcaaaaagtggaccaatagttaggtagagtataactaaaaatgttaaagaaaaccacggactaaatttttccgacatctctgtcttataaccaccattagttagtgtgcctagtaggagggtaataatagctaatccaactcctgacaaacaaaatcctaaaatcgctggccagaaatcttgtccagatgctacacctaatgctggtggaaaaatgaggttccctgcaccaaagaagataccaaataagagtaatcccgttaaaaagcctttttttaccataagcaaccattagtgtaaataatctatttacaccctttccataaattctccttatcaaattctatctaaatgcttagaatcgatgtcttttattatatcaaaaataaaaataaattctaggtcattttcataattttccaactattcagtcacttttttcttgaaaacaaaaaaagagcataatgctcttttcgattaaccaataattgatccatttgccactgctgaatcgaccgtcaacactgtcaatttaccatcatgttctgctgagagaatcatgccttgactgacatattttttcatcattttacgtggtttgaggttagcaacaatttggagttttttccctactaactcttgttcatttgggtaaaattttgcaatccctgataagatttgacgatggccctcatcaccagcatctagacggaaacgaagaagtttatcagaaccttccactttctcaacttcaattacttctgcaacgcggatttcaacagcgtcaaaatcctcaaacttgatttgacctttgcttgatgtcaattcaacttcttcaggaacccactccttttccactggtgcttttccagcattcatttgttctttgatataagtaatttcgtcttccatatccaaccttgggaaaattggtgaaccttttgcaacaactcgaacaccttctggtagatcagcaaaagtcaatttttcaagatcgaatgttgcccctaaaccaagttgttccataatggcatcggaagtttccatcatgaacggttgaatgaggtgagcaacaacacgtagactagcaactaaatgactcattacagctgctaacttatcacgatctgtttcgtcttttgcaagtacccacggtgctgtttcatcaatatatttgttagttcgtgaaataagattccatacagcttcaagggcacgtgggaaatccaccgcttccatttgtttatgatagttttcaatactatctgtcgcaacagaagctaaatcggcatcaaagtcagttgcaacagcaaaccttggtacttctccatcgaaatacttgttaaccatagcaatagtgcggttgagaaggtttcctaaatcattagcaagttcatagttaatacgtccaacataatcttctggcgtaaaagttccgtctgaaccaacaggcaatgaacgcatgagataataacggagtggatcaagaccaaaacgctctactaacatttctggataaacgacattcccttttgatttagacattttaccatcttgcatcacaaaccaaccatgagcaactagacgttttggtaatggcaaatccagcgccatcaacatgataggccaataaatagagtggaaacgaagaatatctttaccaatcatatgaatgtctgctggccaaaatttatgatattgactgagatcgtcagaccaaccataaccaagagcagaaatatagttcatcaaagcatcaatccagacataaataacatgttttggatttgatggtacctgaactccccatgtgtaagttgtacgagacactgctaaatcttctaaacctggttctataaagtttttaagcatttcattcatacgaccatctggctgaataaattctggatgctcagcgtagtacgcttttaaacgatctgcatatttgctcatgcggaagaaataagattcttcagaaactttttcaacttcatgaccagatggcgcaacaccaccaatcatattaccgttttcgtcacgataaacttctgctaattggctttcagtaaaaaattcttcatctgaaacagaataccatccggtatactcaccaagatagatgtccccttgtgccaacaattgttcaaaaattttagcaaccgcttcttcatggtaagtatctgttgtacggatgaatttgtcataggaaatatctaaaagttcccataatgttttgacactttcagccatgccatcaacatattcctgtggtgtaatgcctgcttcttcagccttttgttgaattttctgaccatgctcatcaagaccagtcaaatactgaacatcaaagcccatcatgcgtttgtaacgtgccaaaacatcacatgctatcgttgtataggcagaaccgatgtgcaatttacctgatgggtaataaattggggtagtaatgtaaaatgattttttttctgtcatgatttctcctataagccaccctaatgagaggtgttttttatcatgatacattataacataaaatctttttcaactggatatatctctgaataatatatctacttttgctataataaaggtattaaaaatagagagttaatatatggttaatacaaaaacacttctcccctacaaaactatgccggtttggactgcacagtctattccaaaggcatttttagaaaagcataatactaaggaaggcacctgggcaaaactaaccattctaagtggttctttagtattttaccagttatctcctgatggagaggaaatctcgcggcatatttttgatgctagtagtgatattccttttgttgatccacaagtctggcataaagtttcgccgaatagtccagacttaagttgctatctaactttttactgccaaaaagaagattacttccataaaaaatatggtctcacgcgcacacattctgaggttatcgccagtgcacctctcttatctgagaagagtaatatattagaccttgggtgtggtcaagggcgaaactcactttatttatcgctgctgggacatcaagtgacttctgtcgattcaaacggacagagccttgtagctttagaaaatatggcattagaagaagagcttccttacaatataaaaaggtatgatattaatactgctgctattgaagggcactatgattttattttatcaactgtggtatttatgtttttaaatcccgactgcatttctgatattattttacaaatgcaatcacatactcagattggaggatacaatcttatcgtttctgctatggataccgctgaaaatccttgcccgcttccattcccttttaccttcaaagaaggacaattgaaatcttattacaatgactgggaaatcatcaaatataatgaaaatttaggtgaattgcacagggtggatgaaaacggtaatcgcttaaaattacagtttgcgactttattagctcgaaaattaagatcataaaagtgagtagaaatctactcacttttatctttggttaggtaataagtatattctaaacccatacataattatcctataaaatatatagagatgatatttcaaatcattattgtaacaatcagctttagtatagctcttcaacataaaacgccatacattaggagtgcctttctacttgtaggttataaaattcatggcctaacagcaagttgacatataaaagaggaattaatattaatgataagctccattcgcccagtttacttgaaaaataagtcgagcaaacaacaccaaagataaatcctccaataataataatcgtatttctagcaattaagaaaatatcagaatttttttcgtaaagtccctttgttaataaataagcagcattcttgatattaccagtcatcatcatattagcataaggtgctcctctgagcgatttaaaggtatctacttgtattgaagcaaagaaggctagtcctgccacagtaaacgacgatggtaagaaaggagtcaatataattgttactatagcaacctgtgtcaacgcaaaactagataataggtaccagtgcagttgatgtttattcgcccaacgattcatgaaataagtaaacgattgacctaacatgaaaaccattataggtagcaaaaaagcaagcgcttgactataatgcttattactaagatgaatagcaaaagataacaaattccctgtttgtacacctgcaaaacgttttccttgtgttacataagtaaaagcattgatataacctgaaataaaacagagtgcaaccgcacacctgagcccttcatatatttgatattgacggtgagactttttagacatattttcctctaactttatggcaaacaaaaataagactgggcaatcttgctcagcactttttttctaatagattggtttaaaatagtattaatattagcactagctagcctaacagttctaaataaattattaagcaatgataaatgtagttttagtatatcataacctcagcattgaagcaatctcactttatgaaaggataaagaaaatctcataagtcatttacccttaatttgaagtttaattagttacttttaattttactaccaaaaaacttgcaccattcttaacatttgttacaataaatacaacctattaggaggtcagtacagattatgcacagcactatttataaatgtcatcattgccgttatctaatttataaaagttttaaagatatctttccttttgctctcattttttcttggattgaaatccttcaaaaactcgttatatcagatgattcttttttagctcaaacaacaaagtccagtatttataaaaacgagtggttatatacggtttccaatactctttatgatttatctcatttactaatctactttatggctagttattttgtggctagtttagtatggagagacttatctaaccaaactaaagaaagtttttctgcaagtttacttggctttgccactgtttggttgcttctaacttcagttgttccaggtacagattatcactatcctagccaacccatttggcttatgctggctttgatttcgtatctttttatctttttaactcgactgcttcaaaatcgacatcatattttccagtatagtatgttagctatactactattaatctcttctattttgtcacatatcttatatcgttatcctaatattgatttagaataccttatacaaaatcacttttctcaatggctgggtgatgggccacatcaattaattcctattatgctttggtctatcttagctatttttctaaccttatcaggtctttttgtaccagatattttatttcgtccttactcctatttttcagtagttagcgaaaatttaaatgctgccttgagccaacatacagataaaatcccttatctgtataccttttatactgttaaaaatagctttgctatgtttggcggtattggaatcctattatccttatttttagcagttttatatgaaagtagaaaactacaatcgaagaattactataaattgacattactgaccttaactcctcttatttttgatcaaaatttaccatttttagtaggtctacctgtcattttacaaccaatattattcattccgatggtattaacaactatctttgcagaggcttttggagctcttatgctctacctaaaatttgtcgaccctgcagtttatactgtcccaagtggtacacctagtctactatttggctttcttgcttcaaatggggattggcgttaccttccagtcactgcaattattctagttgttggcttctttatttatcgtccgtttgtcaaaatcgctttcgctaaggaggagcaatatgaaaaaattacttagatggcttcctcctgtacttttcattattatccttataggaatgactatcttaggtaagtcctatatcaataaagtaacagctcacaaaataaaactctataactctcgaatgactcctactattttaattccaggatccagtgctactcaagaacgatttaacagcatgttagcacagctcaaccaaatgggagaaaaacatagcgttttaaagttaactgtcaaaaaagacaatagcattatctacaatggacaaattagcggcaatgaccacaaaccctacattgtcattggatttgaaaataatgaagatggttatagtaacatcaaaaaacaaacaaaatggctacagattgctatgaatgatcttcagaagaaatataaatttaaacgttttaacgctatcggtcattcaaatggtggcttatcatggactattttcctagaagattattacgactctgatgaatttgatatgaaatcattgttaacaatgggaacaccttttaactttgaagaaagtaacacctcaaatcatactcaaatgcttaaagatttaatcagtaataaaggaaatattccatcaagtctcatggtatacaatttggcaggaactaattcatatgatggtgataaaattgttccatttgctagtgtggagactggtaaatatattttccaagaaaccgctaaacactatacccaactaacagtaactggtaataatgctacacattctgacttgcctgataatcctgaagttatccaatatgtcgcagaaaaaattcttaaaaatgagaaaggtaaattaccaaaacctcactaaagctgtaaaatagcaacgcctctggtattttgatataatatattgcgaattaaactaaataaaaaaggatattattatgaaactcatttcatggaatattgattccctcaatgcggcattaacaagtgaatcaacacgtgctttaatgtcacgccaagttattgatactttagttgctgaagatgccgacatcattgcgattcaagaaactaaactgtctgccaaaggacctactaaaaaacatttggaagtacttgaaacttacttcccagaatatgatttggtttggcgatcatcagtcgaacctgctcgtaagggctatgctggtacaatgttcttatatcgtaaagggttaaatcctattgttagcttccctgaaatcgatgctcctactacaatggataatgaaggtcgcattattactctcgaattggaaaactgctatatcacacaggtctatactccaaatgcaggtgatggcctaaagcgcttagctgaccgtcaaatatgggatattaaatatgctgagtatttagcaacattggatagtcaaaaacctgttctagcaacaggtgactataacgtagcccacaaggaaatagacctagctaatcctagcagtaatcgtcgttctgctggattcacagctgaagagcgccaaggctttacaaatctactagccaaaggttttacagatacttttcgttaccttcatggcgatgttccaaatgtttatagctggtgggcacaacgaagtcgtacatccaaaatcaacaatacagggtggagaattgattattggctaacaagtaaccgtgtcgcagataaaattaccaagtcagaaatgattcattctggtgatcgtcaagatcatacaccaattattttggagattgaactataaaccaaaaaaagatgattgagttataactcaatcatctttttatactaagttgaggtctttatacttagtacggtagccaatctgaagaattttattatctttaactagcaatggacgcttaataagcattccatccgatgccaataagtccaaagcttggtcaagagttaaatcatcaaatttatcttttaagcctaattctctgtaagaatttcctgaagtattgaaaaactttttaaggtcataaggcgaattctctaacaattcttttaataacgaaactttgggaggattgctttttatatcaatcgcttcaaaagtcaagccgagttcagttaactctttttttgctgaacgacaagtggtacatttggggtattcataaaacgtatacatattatttctccttttcgtattctaataaccaagattttctttctaagccaccagcataaccagttaattgaccatatcttcctaaaacacggtgacaaggtataattagagaaatagaatttttacctattgctcctccaacagcctgtgcagattgacaatttagctctttcgctaattctccataagttttggtatctccaaaagggattttctgtaattcctgccatactctcgtctgaaatgctgtccctctcaatgataatggaatactaggtaaattttgctgtgaaaaataagcatctaaccacttcttaccaagtaaagtataggaatttgacatattaacaatttcctcttggttgactgctagcatatcatatttttgcccaacaaaataaagccctgataaacctagattgtctgctagaaggcgaatttctccaagaggggactgatagaattcttgatataacatatgataagcataacttaaaaagccatgaaaagcaattcatgactttttagttctttattgttgttttgcaattaaacgtacacggacgatattctcatcaccttcaaattcttcaattaaagtagaaatcttgttattatccgtttcatctaaatctattagtgtgtaggcgtagtcaccctttgaacggttaataatgttatcaatatttatacctaactctgatacagcagttgaaattttagccacaatgttaggaacattcttgttaattaaagtaatacgaaatggtgcggtttgaatttgatgtacattggggaaattaactgaattagtgatttctcctgtctccataaaacaacgaatggtttgacttgccataatagcacaatttagctctgcctcatctgttgatccgcctacatgaggaaagactgtaattcctttttggtttaataattctttgtctccaaaatcagtaatatagcgcttgacaacaccagtttctatcgcttcaaatagctcttggttattgactaattctgcacgagcaaagttgataatcgtagttccttttttcatgattgaaaaagctttcgcatcaaaagtatgcttagtttcatttgttaagggaacatgaattgtgatatagtcacaagtttcaaaaatatccttaatctctttaaccctttgaacatggcttgaaatattccaagctgtttcaattgaaacatagggatcataaccaagaactgtcattcctaagcgtctagcatcattcgcaattctagctccaatggcaccaaggccgataactcccaatttttttcctgcaatttcattaccagcaaaagctttctttcctgcttcaatttgtttgggaatatctgttccagttagagtattaacccatcggttagctcctaaataatcacgagctgaaagtaataaggcagcaatgaccgcttcttttacagcattagcatttgcacctggggtattaaacacgactattccctgtgcacttgcctcttcaataggaatattatttgttcctgcacccgccctagcaatagctttgaggttacttgggaaatcctgattatgcaaattttgactacgaataatataggcatcaggattttctgacatatccccatcaatctggaaacgattccctaactcttgtaaaccaatttgattaatattattaaatgttttgacactaaaaaccattctttttcactaaggttatctctttagtcatcattgaccaaaataacccctttctttttttcttacatgggatttctttcatcaatctcacgatagatgctcgtttctcccttttcttttatcttctgataagccaatcgtaccccatctagaggtactttaccacaatattgatagcctaatttatttagaatatgctgcatagtgacatttttttcatgagtatcgcaacgaaaatcaggtcctttatgaccttcaattaacccttgaaggaatgtctgtgctagtcctctaccacgaaattgatttgagatcgcaatacgatgaaatgtaagatagcgatggttatcatggagccattttccctcataaatagcatcataaacctcttcatgaccatcaatgacagccgcataagtcgctagcatcccatcttcaataccaacccaagcataaccgttcaagatatcatcaataatatcgttacgattagggtatccatcttctttttgccattgatcacttcctgttttagcaatttcggcacgcgcttcctcaataagaagcataatttggtcaatttcatttggaaaagctaatctgatttgcattatattacccacttttatatattatagactataataacggtttaattttctttcgtgataacatttactatgtattttctgcttcaaatgttttcataaaatcaattaattcgatgacaccttgtttaggaaaggcattataaaggctagctctcataccacctaccgaacgatgtcctttaatatttttaaatccacgttctgtcgcttcctttacaaatttttcatctaaatctttattaatagttatgaaaggaatgttacatagagaacgactctttttatctctgacaggattactataaaattctgaggaatcaatataatcatagagaagtcctgatttttcacgattagctttttccatagcatcaacaccacctagacttttcacccattcaaagactaatttagcaatgtaaatactgtaagcaggcggcgtattataaagagaaccagcatctgactgaatcttataatccaacattgatgataaagttggttcctcattaatcatatcttcacggataataactaccgttacaccagcaggtccaatatttttttgagctcctgcataaatcattgcaaaatcttctactttatattttacagctaatatattagaagacatatccgcaataacaggcacttcattagttttaggaatatcataaagcgatgttccttcaatggtattatttgttgtcacatgaacataggcagctttaggatcaatctctttttcatcaaactctggaatataatcataaactgattcttctgatgaagctaatagaattggttcaaaaggaattgtttttgatagttttacagcctctgtataagcttttttccccccacgaaccagcaacatgatagtaagctttacgccctctggcaatattcaagggaatcatactaaactgtaaggatgcaccaccttgtaaaaagattactttataattatccggaattcccatcaaatctcttaagtaacgctcagcacctttgataatatcatcaaactctttggagcggtgcgatacctccaaaacactcatactagacccttgataattaaggagttcagattgggcttttacaagcactggttttggtaagactgcaggacctgcagaaaaattataaattgtcatataacacctccatataattgtgtaagattatagcacagtattttgaatattgtaaagatttttttgattaattttgctttttattcgtgatataatggtaaaggcgaacaatcaagtttaaaggagtaatttatgattttgagggaattttgtgcagagaatttaacagacttaaccagattagataaagctattatttcacgtgtcgagctttgtgataaccttgctgtcggaggcactactcctagctacggtgttatcaaagaagctaatcaatatttacatgaaaaaggtattagtgtcgctgttatgattcgtccccgtggaggaaattttgtatacaatgatttagaattacgtattatggaagaggatatcctacgtgctgttgagttagaatcagatgctcttgttttgggaatattaacttcaaataatcatattgatactgaagccattgaacaacttctacctgctacccaaggtttgccacttgtttttcatatggcatttgatgttatcccgaaatctgaccaaaaaaaatcaatagatcaattagttgctttaggctttacaaggattctcctacatggttcatctaatggcgaaccaattatagaaaatatcaaacatatcaaagcattagttgaatatgctaataatcgtattgaaattatggttggcggcggtgtgactgctgaaaactatcaatatatttgccaagaaactggggttaaacaagcccatggtactagaataactcaataaaaaattcgaaacagggctataagtttctttagtatatttactactaagttctctcatgttttctaaaacctgaaagaaccggaataagagcataccatcttttataacctactctcagaaataaaatccaatttgcaatggtattcaaaagagctgaaattaaaaattttaaggaaattggaagtatcttacttctttattccaatagctaaatcggagattataaaaggttgccaaatttttctttggcaacctttttatattattacttataaatcatggaaactagcatagagttcttgtctattgagattaaattcttttgctactttttttatcgcttgattagttttatcaccattagcgatatattcttttactaatactagtggatcttgttggctactgtctttcactcgctcggtatctctcttaccatcaacaataattaagcattcacctttgagagggaccttttcaatatgctctaaaagttgactaatggttcctctttgatactcttcatagagtttcgtcaattcgcgtactaaaacaacttggcgatctccgtaaatctctttcatgtgttttagcgtatcagagactcgaaacggtgactcataaaagatttgtgtttcagggtaatcttgctttgtttcaaagaaagttatttgttgacctttcttacgaggtaagaagccataaaaaatatgaggttgtggagctaaacctgaagcgatgagagcagtaataccagcgctagctcctggtatagatacaactgggatatccccttcaatagcagccttgacaaggtcatgtcctgggtcagaaatagagggcattcctgcatcagatacttgggctaaagatttcccttcttttaacaaatcaattaacccagagattttatcgtaagcattgtgttcgtgaaaactaatttgtttagtagtaatatcaaagtgcttgagtaaaagtcccgtatttcgtgtatcctctgcacaaataaaatcaacttctcttaaaatcctaatggcacgaaaagtcatatcatctagattaccaattggagttgggactagatagagtgttccgtaatgtatatttgatttaaaacttttttgaacttgcatttccatcaatctctatataataattcaatacaaaaagcacattcttcgtcattttcacgacgttgaccatagaaagtattacaaatgtgaaagccatcattgtaaatgccttcgagtaattctcttccttgtttagaatttttaactgcagtttctgtttctgcttcaataacgctcagacgctcacgaagtttaccattttcaatgcgtagaacagtattctcctccaataatttttggatttgttttttcatagtctcaatttcagacaacccaactaataaattttgtgaaaaatcatcaaaggcatcaaacaagtcttttttatccattcactcttcctctctgcgcgtattattttctaagaaagcaccatatactctaaactattttgaaaactaacattgctcttccacatttgctgagctctataagtattttctaaatcataaagttggccttctttagccagcattattgtcagccattgaaaaacaaatgcctgatcatttttatctacaacttgcgatgtcaagcgagatacttctaaataagcagtttgcctatcttttgccaaagtcgtcacaaactgttgacttaaattcaagtaatctaataactttttgttagtcaacaatatttctaaatgtttaggatcgtctgctacttgagctaataagctagcttgtgattttagcaatcctgcttgttcagcttgatgaaccaacatgtccaattgttttggaaaacgaaaaatttgcgttctactcttaattgttggcaaaacattgttttcatcattagtcaataagatgacataagatgaactttgaggttcttcaataaatttcaaaagactgttggctgcattgacatgcattttttcgcaatctttgatgataaagacctgtgatttcccttcgaaacctgatcttgaaaaatctttagtcagctcttttatagtctctgtcttaataagttgcccctgtggttctatgattttaacatctgaaaattccccattagcgattaaacgacaggctctacactcttgacatggtaaaccactctggcgcttttcacagaactgactttgtgctaaataaagtgccatatctagacttgcaaaatttcccgaaaaaagataggcatgactcatcctatctgactgtaaaatagtattaaacttttccagcaatttgggttgtgttcgctttaaatccatgacctttgtacttcctgattcattggttgatacgatctaaaataatagagaatgtctcagctattacttcatctagctgttgggaggcatcaatcgtcacaatgcggtttggctccgaatccgccaattcaaggtaaccttgacggacgcgttgatgcatatctaattgctcgagatctagacgatttacctccctttgaacacttttttgaatacgctctaaacctacttcagaaggaacatcaaaatataaagttaaatcaggtttatgactatcagtcgcatagtcattaagccattttatatgtgacttatctaatcctcttcctgatccctgataggcaacagaactatcaataaaacgatccattaggactattttcccttcttctagagctgggagtaccttttccactagatgttggcgtcgagcagccatgtaaagcaatagctctgtttttttatccatttgcgtgtgtttaacatctaaaataatatgacgaatttcttctgaaatagttacgccaccaggctctctggtggtgagaatatcttgtgataatttttctctgagcaagggtaaaacagcttctaaaacggttgttttacccgcaccatctgggccctcaaaagaaatcattagtccttttttcatggtacatcctttatttataattactactattctatcaaaatttatcaaaaaaagacacccacaacttgattgtgcatgtctgatatttttaagagtaatttctcaaagtaagttccgtctgccctccaaaaccggaagttagtgtgaaaaggatttttatggtggaattaagtctgagacgtttgggttagaaatgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatgggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatctaacctaatcaactaactgatacaacctaaacgtctcacactaacttcaaccatagcggaacttaatctgaaacgctttcagatgaggatgttttcttgtaccctttttttgcgatttttaactctgaaaacctatgaaatcaagtattataaaaaccaacgaaacttagtctgagacggattttcgttggtttttattggtttttatcagactaaattccatttctactagaggtggaacttactttgagaatttagctgatatttttaagaaagtggttttttcatggtcttttctaaagtttccacaataacatcatcaaatactagttcttgttttaaaacatccttgtcagcgtatccttctagttgtatctcgaccgctttcttacctgcttttcgttcaataatgactaaacgtttaacacttaaatttgcactagaaagacgatttaggacttttgatagtacccctatcccctcatcagctaatataaccaagcgataactttcttgaccataccccgcaatttcaaggaaggctttaaaaacatccctatccgtgacaatcccataaagttgtccattatcaactactggtaaaacaccgatctttcgagacatcatcaaataaatagcgtcctcaaggctagcatactgtgaaacagtcacaatatctttaatcataatatctcgaatttttgtcttattaagaagatagttcatctcatatatagaaagactggttgctttagaaggttgtgcttctgccattgtcccttctgtcactaaccccactagctgatcattttcaacaactggcaaacgccttaagtggtgttctctcaataaatcagcagcttctgcaactgtagtatctggagagacataaactaatttttttgtcataaaatctttcactggcatacctgactcctctaaatattatccacctaagtaagctttacgaacttgatctgaaactagtaattccttacctgtccctgataaaacaaccttcccagtctctagaacatatgctttatcagcaatcgtcagagctttatttgcattttgttcaactaaaagaactgtagtcccttgttttttgatgtcttcaatgatattaaaaatttcttgaataaaaattggagctaggcccattgacggttcatctaaaagtaataatttaggacgactcatcaatgcacgccccatagcgagcatttgctgctcaccacctgataaggttgctgcatcttggtttttacgttcttctaagcgaggaaaacgatcaaacactttttttaacattttttgattttgttcacgatccttttgaagaaaggctcccatttctaaattttccataacagacaaacttgagaaaacgtggcgcccttctggaacctgagctaaaccattgccaacaatttttctagctgctaacttatgtataggtttccccataaaagaaatagaaccctgacttggtcttactaaaccagaaattgtcctcaaaattgatgtctttcctgcaccattggctccaattaaggttacaacctcaccttggttaacttcaaacgagacatcattcaccgcttgaataacaccatagtgaatagatagattttctactttcaacatggtcattatagctcaccccccaagtatgcttctataacacgtttattatttttaatttcttcaggtgtcccgtgagcaatcagacgaccatattccaatacataaattctctctgttacttgcataaccaagttcatatcatgttcaatcagcataatagtaatatcaaaatcactctttatttgactaattaactgcgtcaattctgcagtttcttgaggattcattcctgccgcgggctcatccaaaaacaatatttttggttctgttgctaaagcacgaacaatttctaaacgccgttgttttccataagggaggttcttagcaagagcatcttgatatgctttcaaaccaaaaatctctaatagctccagtgcctttttccttaaggctttttcactatgatagtatttgggtaatcgtaaaaaactagcaataggatgtgataagtgatgattactgagtcctactagtacattgtctaaaacagtcatatttttaaaaagtcggatattttgaaaagttctacctaaacctaaagaagctattttagctggtttcctcccatttaatatcttaccatcaattgatattgtccctttactaggaaggtatactcctgttaagagattaaaaagcgttgtcttacccgcaccgttggggccgattaagccaattaattcacctttatgtaatttcatcgaaacatcacctacagcagttaggccaccgaaatgtttacttaaattttttacttcaagaagtgccatctaattgcctcccttactcgtcttacgaaatagatgagatagagttaactctttcgttcctaataaaccgctaggtctaaaaatcataattaaaatcagggctaaagcatagataatcattcgaacagaagcgtagtcttgtagtaacatattcaataatcctaataaaattgctgctaaaactgtccctgtcattgaacctaaaccacctaaaacaacaataattaaaacattgacagacatcataaatgaaaagtcttttggcataacagttccaacgtagccagcctgtaaactaccagcgatagaagctaaaatagctccaaaaacaaaaacaattactttcacttttgttgtatccacacccatagactctgctgcaatttcatcttctcgtatagcaattgtattacgccctaagggactacgcaaaaaattcattgcaaggataaggctcacaactgccaccccataaactaaagaccaggttgtaaaaggcggaatccccatgatacccgcagcaccattcgtaatatcacctccattaaccaacaaaatacggataatctcagcaacacctaaagtagctatagctaaataatcaccttttagtctcaaagtaggaattcctacacctaaggcaatacctcctgcaacaagagttccaacaagtatagctatcaaaaaacctacataagttggcattttaacgccgataatagcaactgcataagcgccaatagccatgaaacctgcatgtcctagtgaaaactgtcccgaacaacctacaattaggttcaaaccaactgctaaaataacattaatcccaattgtttcaataatttgaatatgatagaggttaaatatacccatagatattagcacgctaatcaagagataatctaacactactatagctaaccaagataaaattgatttcatattttctttcatgcctagaccttctccttaatattttttccaagaattcctgctggacggatcaagaaaatgagaattaaaatagcataaacgataccatctcgaaaatctgacacaccaagtgcagtcgctaaagtttctaaaatgccaataacaaaaccaccgatagccgctcccggaatgataccaataccacctaagacagctgcaacaaatgctttcaaccctggagttacccccataagaggttgaacagaattataataaagcccaatcagtactccacctgctccagctaaagcagaccccagcgcaaatgtaaaactaatggtacggttaacattaattcccatcaattgtgcggcatcgctatccactgataaagctctcatagctttccccattttagttttttgaacgatgaactgtaaagtaagcattagtaatagcgcaatacctaaaatgatgagctgaacattggttatagttatcggtcctaaattatatttaacagtatgaatggcttgcggaaatgccctagtatccgctccaacaaggtataccatcccgtactccaaaagaaaagaaacaccaatagctgtaattaacgcggcaattctagttgattttctcagtggacgataagctaaatattcaattacaacacctaggaaagcagaccccagcattgcaattaataaagctaggaaaaaattaagatgaagatgattaatcaaataatagcccatgaaagcgcccatcatatagatgtccccatgagcaaaattaatcagcttaataatgccatataccatagtatatcctaaggcaagtaaagcatatatggatcctaagataagtccattaacgagctgttgaagcatattataaccatactttctattatatattattgtcgaattattctgaaaaattactttttaaaaaaggggagctgaaaattaaactcccatttttctagagaatacttattttgctgaaataatgttaacgctacttgtttttccatcctctaatttgacaacgtaagctgatttaacaacattgtgatttttatcaatagacattttccctgtcacacctttaaaatctttcagcttagctaaagcttttttaatatcaattgaagttttagctcctttagcagatttagctgccatatacacagcgtcgtatgataaagccgagaacatggatggttcttcaccatatgccttaacgtaatgatcatggaaagctttagctttggttgatccttgtgtagtgaaacctgtcaaataataaacgtttgaagctcctacaggtgttgccgattgcacaaatttcggactatcaaaaccatcaggcccaagaaccggtttagagatacctaaatcacgcgcttgcttaactattaatcctgtctcggtatagtaacctggcatcacaatagcatcatattctttccctttcaacttagtcaatgacgcttggaaatcagtatcaccagcggagaatgtcatactatcaacaatttttccactataactttccttaaatgattttgctaccccctttgagtaatctgatgaattatcataaaatagaacaacttttttagctttaaggttgtctgtagcatactgagacaatagctttccttgataattatcgacaaaagtagctcggaagaaatactgatttaaggtttttccatcagaaccatagactaaattgtcttgtgtcgcagcaggtgcaatcattggaactgctgctgcatttacttttggagttgaagatgcagctgcacccgatgttgctggtccgataatgacattagctcctttggtaaccaagtttgtggcaaccgttgctgcctctgcattttctgatttattatcctgtgataggacttttaacttcttgccgccaacccctccagcagcattaatttcttttactgctaagtcagctccattcttcattgaatttccatacgaagaaacgtttcctgataattcccagttataccctaccttaatatctttccctatttttgttcctgtcgaagatgctcctcctccgacatttccacatgctgctaaaagaactgtactagctaaaacaagcgctcctaaactaagtctcttttccatatttttctccttttttgaaaatggtaactaaaataatacagaattatcagaatattgtcaatagtttttaaattgtttttttgaaaattatagaaactaaataaaaaagaaggacatctgaactccttctttctaataactactagtaaatatcttaacgatataagtttccaacaaaatcctgatcaatatcatcaattgctgataaccgaacatccttaacaaattttaaatgttttatctctttactaacgctaacaatatcctctttattaacataaatgactagatatcttaatctacgagaatgataatgaacatctccgtatttatataatttacgagcgtcacgattatagtaaagataaacgctcattcctaaacgctcttgtttattcaataattttttcctttctgcgtcatatctgtaattactaagattataacataattccaacaaataaaaaaagagttggtaaactcaaccacgccgtacgcatgaaaactttctcttcatccttttgtgcccggacatcaattttgaaaagattcctttttaaatcaatgatctgcttagcctctttctccaaataattggactaaataatcttccaaatggacagaaatataccgttgtttgcgacgataactgaggtcttttttaggaaataccatcactttgagaaaatataagcacatttttcggataagatttaggttaaatgcggctcttttatccaatgtctgatgatgatcttcatgataaacaacgtccaataaccagtgcatactctctatctgccaatgacctcgtacacaattggcaaatgtgaggacatccggcttaaagctaaagataaaataacgattctcttgactcagctgaccatccttatcaatcgtgttacgagtcatcccaataccacgtaacttatgccatttgggatggttttgacacaaccatttgatatcggaagacacccagtattctctaacttcaatctgtcccctagatttttcaacagtctgataatactgcgcattttcttggagttcttccaataagttgacatcactaaaataaagagcaatatcatcataaagtgtttcttgatttcctttgacggctaagcaatagtctgctttaccttttataatcgtatcaacgatagccgtctgcgtgcccattgcgtctatcgttacaatgcttttacggatatcaattgtccgcaataactgaggaatggcaacaatttcattacttttctcctcaaccgctacctgtcccaaactaagatgatgacccccatcataagccgttacaatatgaacaggcttctgatttttacctcgattgcctcgaatcgttttaccgtccactgaaatcagttgatgaacggcatctaagcttgtcaatgattgctcaaattgaactttaagctcttttaaacggtctgaattaacaagactaatcacacgctctaaggtatcatgagacggacaaccttcactcaaatcaacgtaggtcgcaaacaatggttcattcatttcaataaaatcttccatctccttccaggtttcaatgccagctaactgacaaacaaagacaagaaatagaatggttgataaggggtagcgaattttccaagattgacgactatccaattcaactgcgcaatcatcaatagaaataataaaatcaatcatcgtagtcacctcatctatagtgtactactttgattgattttgtcattatgaatctagttttctgaaaacaaaagtttcttcatgcgtttggcgtgtaaactcaactcttttaaatctattattgtaaattattattttccataatagcatcaataaagccataatcaagtgtttcttgagcactcatccaacgatcacgctctgcatcatcatggactttttcaatagattgaccagaattatcagctaagattttttctaaagtatgacgcgtttttaaaagatgctcagcagcgatagccatatcagattgctgtgtacctccgcctgttccgcccattggttggtggatcatatattctgcattcggtaacataaaacgttttcctttagcaccacttgaagcaataatggttcccatcgaagcagccatccccataacaatcgtctgtacgtccgatttaatgaagttcatggtgtccacaatagcaagtccagccgatactgaaccacctggtgtattgacataaaggtaaatatcctttgtattatcttgtgcatcgagaaacaataactgtgcaatgatactattggccatattatcctcaacttggcctgtcaacataataatacgatcttttaaaagacgtgagtaaatatcataagaacgttcaccacgacttgtttgttcaataactactggaatcatatctttctccatttctttttatcactgtcactattataatcatttggtcaacaaaggtcaaataataacttttttaagaaaaggctttctgagttcttcagaaaagccttattcatctcaaatcttattttgtaccaaataagcgatccccagcatctccgagtccaggaacaatgtagccatgttcgttgagtttttcatccaaagcagcggtataaatatctacatctggatgtgcttcttgaagtgctgccactccttctggagctgctactaaacaaacgaatttgatactagctgcgccacgtttttttagagaatctactgctaaaatagcagacccacctgtagcaagcattggatcaactacaaaaatctgacgttgatcaatatcttcaggtaacttaactaaatattcgactggttggaaagtctcttcatcacgatacataccgatatgaccaactttagcagctggcacaaggcttaagaaaccatcaaccataccaatacctgcacgtaaaattggaacaattgctaactttttcccagctaattgtttttgtacagttgtcgctactggtgtttggatttcaacatcttctaaaggcaaatcacgagacacttcatagcccattaacatcgcaatctcatcaactaactcacgaaaatctttagtagatgttgtagtgcgacgtaagattgacagtttatgttgaataagtggatgtgaaatgacttgaaattttcccattataatgaccgctttctatttaattttgagcattaaaaacattctaatgcttgtttacattcaaagtattataacataaaaaccctttccatgcgactttttttatagtctagtcattttttctaaagtttgtcactaatcgcaaaactgcctcctcaataacagacctaggagctgcgacattgattctagcatgttttttcccttcttttccaaaagttaaaccatcatttaatattaatttggcatcatatcgaagtttttcttgaatttctaaatgcgttaaattataagcagaaaaatctaaccaaacaagataagttccctctggtttcatcactttgatatgagttttttgcgttaattgctcataaaggtattctattgatccttctaactccatttttagggcctttaaccattgtttctcttttgtaaaggcaacttctgtagctaataaccccaatgaagaaatttcttgttgattgttagctatttgcctcttcttaaaatccgagcgtaacttttcattttcaattattgcaaaactatttttagtccctgcaatattaaacgttttagttgcactagataaaataacactcaattctttaaaactagaatcaacagtattaaagctatggtgtacattatcaaataataccaaatcttgatgtatttcgtcagaaacgaggataacattatatcgtttacagatatctcctattttttgaatttctccttttgtccagacacgcccaccgggattgtgtggactacaaaaaatataaagctttacattattttcaatgatatctttttctaattgtttaaagtcaatctcaaaatactgattattattaagtaaactatttgaaactaaatgacgattattgtattttatagttctagcaaagggcggatagactggggtattaattagaacagcatctccctcctttgtgaaggcttgtatagcaactgaaatcgctggtacaaccccatcaattaataataatgattttttatcaaattgataaccatgttcttgcacttcccaattagagatagcttggtataaactgtctttaggactatcatagccaaaaaccatttggtgtgaaaaatcttcaatagcctccgacatttctggaaagataggaaaatccatatccgcaatccaaaggggaaggatttcttgatctttttgaaccgccttccattttatggtattacttgaaaaacgttctggtaaacttgtgaaatcatatgtaatcataattactcctgactattctacagctaaaaatatcccttgtcgccttggtgactattttaccatttgtttttgatactatatactaattaacattctaaagataaaagtgaccattttaaacgatcactttctttattattttaatttatcattttcataagtatggcttaattctaaattaggaaagctttgctgcctaagggcttcataaacaatcatacaaacagtgtttgaaacattcaagctacgcacatgctcatcgttcatgggaattcgtaaggccttttcggcatgctcgcgcataaaagtttctggcaatcctttatcttcacgaccaaacataaaataatggtcttgatcatcattgtaattttcatctgagtaaaccttgtcagcaaatttgctaattaggtgaactttccctcgacatgacaacataaattcttccaaaccatcatagaaactaacatctagcttatcccagtaatccagtcccgctcgtttcatttttttatcatcaataggaaatcccatcggtcgtatgatgtgcaaaggagcatttgttgccgcacaagttctagcaatattaccagtatttgctggaatctgtggttcaaataaaacaatatgatttcgtccgctatcggaacgatgatttttctgcgttagtgtttcaatattcatctcatcatcactttctagaactcattctgactcgcaaaaaaaccacactgctcggagtcaatctcagcaaacaatgtggtttatggtggtttgttaacttaaatcataacaggtttgatttaaactaacaaatcgttgacactattatagcacttcagtctacaaagtcaacctattcatgagtttttgggttatttttttgatagatataatgacaaatcaaacagaataataagcaaaaacattggaaaattaaaaccgtaaagaaattacttaacaaactcccgataaggaggatcaaaccgcctaaaattgctagaatcggtgaaactaagccggtaaatttatttttaatatcttttttgagataaaggctgagtactaaaacataaagaatgattaaactggtattattaaacaccacagcaatttcactaatatcactacccggcaataagttaaattttgtaaccataaaatgaacaaaaagccaaaaaatagctacagccgtcaccgtcaaactagctggcaatgacatttgatacttcaaatttatgttagccatcctctcacttttgatccatccgcgttccgcaaaagcttgaggtagacgcatcgtcccaagtaaaagtccattggcaacacctaatacagatagaataacaatgaaagataataaacgcccaacactaggaccgaaaataatattagctgcataattaatagcatcattaccggttgtcataataaagctagcacctaaaatttgtgtcaaaccatagaaaaatgccaaatatgataataagataagcgctggaccaatgacaaaggcaagtggtaaattcttcttgggattcttgacttctggtgcaatattaacaaaaattgtccaaccatcatatgcaaaatacaatggtaccagacctgacacccaactccatccaacatttgacggttgaatagctgttaaatgttgtggaagttgtggagctttatcagaccaaaaagcaccaattaaagcaattagaactaaaggaatcatttttacaaaggtcgttaaagattggaatccccctgcaatacgcttagcaaagatattcatgagactaagcgctaaaatataaacagcagctaaaataatctgtgattccaaacttgatgattcacctaaagtataaaatgcagctacccatgaaacgattgctgttaaagttggaagatacaaaaaagacgcaaacaagcctaaagttgctgctaaagctgggctaacatatttttcgtagtaagaaaaaataccaccactttcactcgttctaatagctagctcagaaattgacaaacttccaaaaacaatcgaaaaagaacctagtactaaaattaccatgcctaaaaagacatctccaccagtaaatttaaggatgtcatcaactttaaaataaatgcctgaaccaatcactacacctacaatcatagcaattgtagtcattaatccataggtctgtttaatagaattatgattctccataatatctccatttctactgtacgcttaaaggttaattataacctaatttagggcttgtcacaagtttatctgtgttatttttcaccagattctgataagagaatcatattactcttatcagaaagatgaaaacgttttttaaccataattctcgtgcatttttactaaaaaaaaggtatcatagagtttattattggaggtaaaaatgagaataattgttgtcggcggaggtaaagtcggaaccgcactttgtcgctcacttgttgctgaaaagcacgatgttgttttaattgagaaaaaagaaaacgtccttaaacgtgtcactaaacagcatgatattatgggaattgttgggaatggagcaaactataaaattttagaacaagccgaagtcaaaaattgtgatatttttatcgctatcactgatcgagatgaagttaatatgatttcagcagttcttgccaaaaaaatgggggcaaaagagactgttgttcgcatgcgtaatcctgagtattctaatccttacttcaaagataaaaactttcttggcttctcttcagttgtcaaccctgaattgttagcagcacaatatatcgctaataccatagaatttccaaatgcaacttcagttgaacacttcgccaacgggcgtgtgatgttaatggaatttaaaattttagaaggaaataaactctgtcatacttcaatgagtcaaattcgtaaaaaatttggtaatattgttatttgcgcaattgaacgcgatggcaaattgattattcctgatggcgatgcaactatccaagtcaaagataaaatctttgtaactggaaatcgtattgaaatgatacttttccataattacgttaaaaataaagttgtcaaaaacttgatggttatcggtgcaggacgcatcgcctactacctactcaatatccttaaaaataccaatacacacgtcaaactagttgaactcaaccaagagcaagctgaatattttagtcaagaatttcccaatgttcctgtcgttcatggggatggtactgctaaaaatattttgttagaagaaagcgttacaagttttgacgcagttgctactttgactggtgttgatgaagaaaatatcattacctcaatgttcttagaaagtatcggtatccctaaaaacattaccaaagttaatcgaactagcctactagaaatcattgacgataaacaactatcaagcattatcacacccaagcgtattgccgtagaccatgtgatgcactttgtacgcgggcgtgtaaatgctcaggattccaacctagaagctatgcatcatattgctaacgatcgcattgaaaccttacaatttgaaataaaagaaactagcaaattagcaaatcgtagccttgcatctttaaaattaaagcaaaatattttaattgcagcgattattcgcaataataaaacgattttcccaactggtgaggatgttttaacagtgggtgatcgtatcgttgttatcaccttattaaaaaatattactagaactagtgatatgttagcgaggtaggaatatgaataaaagtatgattcgtttccttctctcaaaacttttgctaattgaagctgctcttctagcgattcctctaactgttggacttatttaccgtgaaccgcaaagtgtcatgatgagtatagtcattaccatgattattttaatcatccttggattactgggttctctctttaaacctaaaaattatcatatctacactaaagaaggcatgttaattgttgcactctgctggatactttggtccttctttggcgcccttccatttgttatttcagggcaaatccctaatattatcgatgctttctttgaagtatcttctggttttacgacaacaggagcaactattcttgatgacgtcagtgtcttatcacccgcgctcttattttggcgtagctttacccatcttatcggtggaatgggggttttagtatttgcccttgccatcatggaaaattctaaaaatagccatttagaggttatgagagctgaagttcctggacctgtatttggtaaagttgtctcgaaacttaaaaaaactgcacaaattttgtatttgttatatcttcttatgtttgcagtatttgcagtaatattatattttgcaggtatgcctttctttgatagtattatcatagcgatgggaactgcaggtacaggtggttttgcagtttacaatgatagcattgctcattataatagtcctctgataactaacttagtttctattggtatgcttatcttcggggttaactttaatctttactatcttcttttactccgaaaaattaaagcattctttggtgatgaggaactaaaaacctatctccgcatcgtggcaatagcaactttcatgattgctctaaacgtcatcggtatgtatgataattttcgacaaggcctcgaacatattttctttgaagtatcagctattattacgacaactggttttggcgtgactgatatcactcgttggcctttgttttcacaggttattttgctattcttgatgtttatcggtggttctgctggctctacagctgggggctttaaagtcatgcgtagcttaatcctagcaaagattgcacgtaaccaagtattgtctacactctatcctaatagagtcatgtcactacacattaataaaagcgttctagataaaaatacacaacatggtgttttaaaatatctaactatctatttagctatcttcatggcactcgttcttgttttaacgcttgatactaatgattttttggttgttatcagtgctgcagcctcatgttttaacaacataggcccactcttaggtagcaatgaaactttctcattctttagtccattctcaaaactccttctttcatttgctatgatagcaggacgtttagaaatataccctgttttattgatgtttattcctaaaacatggtcaaaactataattacaaataataaaacggatatatcaatctgatatatccgttttattacgtcttaagctaaaatgatcagggacaggatcatttcctccgtgggctaagggatgacatcgcaaaatacgtgcaatccccatcaacacaccttttagaccatgtttttgaatagcttctatcatatacgtagagcaagttggacgataacgacagctagctgggaaagctggagaaatatttttttggtaaaagcgaactaagaaaatcaaaaaagatttaagcattaagatttattaatagccgcattatgcaactgactaatttcttttttatttaatcgtcgtgcttccccaggacggagacccgttaaatctaaggtaccgaattgtgtacgagatagcttgtccactaataacccaacttgttcaaacattttcttaacttgatgattacgaccttcatgaatagttaattcaactactgaacgatttttttcatgatccacttttatgatagtatagcgagcaggttttgttttcttaccatcgataacaacgccacgcgttaatggtcgaaggttttctttagtagctattcctttaacacgtgctaaataaactttatcaatttcattacgaggatgaatcattttatcagtaaaatcaccatcattagtcaaaattaaaagtccagttgtatcccaatccaagcgaccaacaggatatatccgttctttgacttgtggcaacaagtcaataactgtcttacgtcctttatcatctgagacacttgaaataacaccacgtggtttatttaagagataatataccttctcttcgttgtaaattggacttccttcaatttcaaccagatcaccagcctttacttgggtcgccaattcattaaccacttgaccattaatcgtgaccattccttgcttgattaattcctcagcttttctacgacttgcaatccctgcatgcgcaatatatttattaattctcattgttttccttatcttctgtattaattgaatccattgaaaataacgatacttcttcgtcaactaattcaattgaagaggcgtcaattaagtcatctaactgattaattcccatataatctaagaaataattagttgtctcataaaggttaggacgtcccaacacttctttctttccagcctctttaattaaaccaaaagctatcagtctcgttatagctccactggaattcacgccacgaatatcatcaatttcaatcctagtaataggttgtttataagcaataatagatagaacttccaaacttgcccgagatagactctgattaatcggagccttcgcataatctctcaacaaagtcatataactatcctttgttaccaatttataagtttgtgctgtctcaagcaataatagactagaatcgtcatcttcttcatatcgtttagccaacttttctagttgctgtattaatgctgatggtgtcaaagacaataattctgccatttgacgcaaactcagtccatcttcacctgcaacaaaaagaagagcttctattgagcctaaataagtcatttctcttcctttcttaagataacttgactaaaattactgtcttgttctactgtgatttgatgtaattttatcaactctaacattgccaaaaataaagttatcatttcagattttgtttggcaatccgcaaacacttcttgtaatgtcgttttctttttaagattaaaatgtctttcaataacgatcatcatatcttcaatacggtagtcttctttctcaattaccgtttgactatttgacaattctttttgtttttgggacatcatttgagaaaaagtcaaaaaaagatccatcaccgatttatcgtgtagaagaattgcatcttcaaagataacttcttgttttggttttgaaaaatatttggcgcgttcctgatgctgattagctaactcttcacttagcactttaaaacgtctatattcctctaattggctcaacaattccatttctggatcatcttcaataggatttgactccactactttaggtaataagttacggctttttatcaacatcagctgacttgccataagcatatactcaccagctacttctagacgcatcgcctgtaatgttgctatataagcaaggtactgctcaataacttccacaatcggtacatcgtatatatcaacctcatatttagatacgaggtgcaagagtaagtctaggggcccctcgaaatcttttaacttaatatccattatctataatatctctctaaagtgataggagtttttaagcctagaaggcgactgagctccgtcatcgttttgccattttctttttgctttagaataaattgttctcgcagaagttgtgcagttagttgttgctcattcttctcatttaagaaatctgttaattgattaaaaaaccattgtctagaataaggcttaccgttatgctcaaagactaagtcaccatcttcctctaaagattccaaaagaaaaggaagcaagtcttctggaagttttaaaatacgcttcatctgcgatttttcaatacttaagatattaaaagttgtatcaaaatcagccttcttcaaattagcaatttcagccggagttaaacctaaagataaaatcaacaaagcaatcaaacgaccactcggataatcagtatcttgatagaaatttgataaatccattatttgagactttgtctgagccaaagtgattttttcagtctcttgtagtctgtaaaattccttcagcgttcctctattatataaaaagaaaagaaattgattgactgcagataactttcgcttacgagctgttaacttaaattcacttagagactgttgatacaatgccagtttttcagaatttacatgtccaccaattattttataaaattgctttaaatcatagtgataggacttacgcgaattgagagataatttcttactctcaataaaattattaatatcatttatcattgtttttaggagtgatagtatattcgtctgtaaaatcatgtaggaggctattaatagcttttaaaatcgatttacgggttataatgcctctaaaatcattttgatcactgataacaggtaaaaatggataatctacaatcttatgcataattgctgtcagagtagctgcctcattaatcggctcgatttttgtattaaccatctcaacaatatcagtctgtgccatctcccaatctgttaattgacctttagattggtagcccataatgtctgagatactaatagtacctacatattttttctctttagtgataactggtacacgtgaaaaaccattacttgctaatagtaacataacgtggtctgcattgtgtgtatccacaaaaatagcaacgtcttcagctggaattagatagtggtccaaatgatttagcaaaaacgactcaaattctttagcaatcatcttgataattcctttgtcaagttaggatagggttggtgttggcgagtataatactctaccaaaaccttactatctgttatagttacaacagcgtaaagcttctcatttattggtcctcttggctgcaaaacactacctggattgataaaaatagttttaccatttttccaagcatctgcacgatgaagatgaccatataaacaaatatccgcgtcttcttgctgagctaataaatccaatttatcccaggtaaaattaatctgatggagatgaccatgggtttgaacaataacagcattatctatttttgtaaccaaaacttccggataacctgaatcataatcacaatttcctgtgaccacatgaatgccttcccatataggatctgagctaggaagttcggaatccccattgtgaaaaatagcatccacttttcccaaataatgattctttatatcttttacaatgtcacgatctccgtgagaatcactcattacaactaattttctaattgccattttggaaatacctccatcaatttacggacagcttgcccacgatgtgatagattatttttttcttgtgcgctcaattcagctgctgtcctactaccttctccgacaataaagagcggatcataaccaaagccattttcccccttaggttccgtaccaatataacctggccactctgcttcaactaccaaactttctttatttggagctgacacgactaaggttgtatgaaactgtgctgaacgtctttctttgtcaaataccatggctaattcatgcaataatttggcattattacgagcatctgtcgcgtcaggacctgaaaaacgagcagaccatacccctggcaaaccacctaaagcatctacttttaatccggaatcatctgaaattaccatttttccagttaattttgaaatagtctctgctttaagtcgagcattttcttcaaaggtcataccagtctcttcaacttctggtaaatctgggtaatcatttaaattttcaactttgagtcctaatttcccaaataattctctaaattccttcgtttttccttcattgtgagtcgcaattaatatggtatccccaaaattattatcattctttaaatcaaagaatttttctaaagaagtgccctctttaggtaagtgaactaagaacaactgatcatcttcactaactaagatggcccctttatgttgagtcactttgatatgccttgaatactcttgattaatcatatcaacgaggaatgctaataattgaaaatccgaagtcatctgcacaacgtgaagctgtagaccttcaactttcaaagttgataatagacgatgaaaaacatcttggatagcttcgtaagattcatcattaccaaaacaagtaaaataattaaaagcttggaaactacctaaaaaccaattgccttcagttttactttcaaaaattgtttttgtcataatacgatacgctccacatttatttcttgactaagccattgttctgcaatttctttaaaaccttttgggctggcggttgtgtaaaagtgatgaccaccgtgtttattttgccaattatggtttatctcaaaatagttcaataaaacagaaatatcacgaacggtttctgcgccactatcaattaatttaacctcagcccccataacattttgaatgatgggacgtaataggggataatgcgtgcaacctaaaattaaagtatctaatttaccaactaatggggacaacgtttcataaaccacctttttggctaaactagaagacatctgatttgattccacaattggaacaaatttcggacaagcaagggataccacagcagtatttggagacaaagcttgaattttttgacgataagcatctgatttaacagtcatgggagtacctataataccaactttccctaaattagttgatttgatagctgcgctagctcctggtaaaataacgcctaaaacagggatgtctagtttttctttaatttcttgccaggcaactgcagttgctgtattacaagctataacaatcatcttaacatttttagtcaataagaagttaaccatctgccaggtaaactctctaatctgttgagcaggtctaggaccatacggagctctagcctgatctccaatgaagattacttcctcttctggaagttgacggaacatttccttaacaaccgttaaaccacctacaccagaatctagaaagccaataggcctactatccatttttattcctccaatattagtgactaaaagaggctggacaacagtcctagcctctctatacaataaccaatcagtcaaatctacacttgaccaagtttgcccaaatcttgtctagaaatctgatggactatcactcactatttcatcactaaacgcttcaatgctaaaacactcttattttttagttttgatagctgtttttgcgtgttttacaatattacggtatgtttgttgaactttagcttcactaggtttttgtcccatttgactcatcatttcacgaatagcatccggtgttaaacgagggtgctctccaatctctttttcaatttgtttacgagcaataaaaatgcctcccacgagaccaccaaacaaagcgacgataattaataaaatccaaatagttattgacatctattcattctcctcatttatttacatgactcattatagcaaaaaaagaaagagtttacaaatatatgtaaacaaaatcaaagcctctatcgtccttgtcacgtcaatacactattaaattttcactagagcatggttaagcacatagtcgagtcctttatcttatcctaagtgttttccccaacttttgtgtcatccatttccaaatgaagagagctatgtaaaaatctaccaatccatgtagcaaagagcctagtcctatcaaagaaaatagtgaccataaataagttgaactactgttagaagtcattgtgattatataaacagtaataaattcgagcagaccatgaattatgttaatagctacagcaaataacaatgtttgccatttactcatcaataaagagggctttgacttaatcaagaaagccgcaattaatgcaaatccgatatgtgataaagctctaagaacgattacaatcggaaaaccagctagtagaaatccaagtcctgtccctaaagctaccaatattgcaactggaacagatataaaaatacttaaaaataaaggtacatggcttgctaaggtgaaagaagcaggcccaataattattttagcaggcatgattataggaatcatgattgcaaaagctactaaaatagaagtataagaaaccatttgtgttgttttttttgacatttttatctcctttgaagctattatacaaaacaaccttacaggtgtaaagacacctgtaaggttatttgtctatgtataaaattcctgctttttttagagcctcacatatttggtcaaaaactgactgatcttgacaagaaatcatatgtgtatgtagaccatctgtcaaagaggatagcaattctgcattggaaacttttaatttagcagtaaaattatcaatgtctttttggctttgaatgtttaagggagcagtcagcatcccataaatagggtgctctacctccacattcataatgattccttgataccgcaaaataatttccagttcttcttctgtctgttctatgccatgctgacaaaccaatctagctgtgaattgatgagtacttagagcactggacataaggtatccttttggggtagaaataatatcacattgttgtgcacgcaataaggcaatatctccaacaatcacctgcctactaacactaaaaatctttgctaatgtgcttgccgatatagcttcttttgttccttttaaagtcgttaaaatattttctcgacgctcctgtgccttcatataacaaattccttctttggtgttatttcacaattaaaaactggctagaatatctaaccagttagcctcaatcatttcgtgcaaaaagacgaagaatatttaagaatagattaataaaatcaagataaaggcttagtgccatcgaaactgcccaaccatctgcgacttggccgccttggctattgtagacatatttaatcatttggttatcgtaagcaatcaatccagaaaagatgatgacacatacgatactaatgatataactcatacccccactaccgataaataaattaacaagacttgcaattaaaatcccaattaaagcagccattaacgctttacgcatacctgataaatcttttttagtcttagctccaatcaaagccattgcaaagaaaacagccgcagatgttataaaagcttgaagaactgtagtttgcgtgtaccttgcgataatgaaacttaaagtaaacccattcaaagctgaataaatcaaaaataatggtaatgcagctggtgtgtttcgacgcgccgctccactagcaacaaagactaaaaccaattctaagatgattgctccaaaatacaaccctggcattttttgcatgatggcaatcatattttgtggaaacatatacagcataatcgcagaaacagcagctgacaaacctactcctatccctacaagaccgtaaatcttagcaaaaaattgattcagccctgaatcagattgtgtgtaaatgacgttatcattcatatgtattttcctattctaaattttaatgattatgactacctaagaatttgcgactaaaacggataggtttcttaaaaatacgtttgagtggacgagaagcctctcgtactgcccaatacttatcaaccatagtcacaatataactttctttataacgtggcggtgcaatagtcgctccccacatgtgcttcaaaataatatcttcttctctagcgtttaaatcagttaattttcgcgcattacgaaccgctatccttggatgaacccaggcatggctcttgttaaatttcgttacacgccaatcataataaaagaaatcatgtagtaaaccacctcgagcagtactactcgcatcccaaccaaacttcttagcaattttataacttgtataactaacatttatagaatgctctaagcgagttgagtgatgatgttggacaatagcttcgagtttttggaaacgtggatggtcaataaggtgaccgaccaaatccatgaagtccttatcgtcttgatactttttcattataatcacccctctggggatattataacatatgaacttaaattaagctgaaaatgactactcccgcagctactgctacattaagactttctgcttgtccaggcatttcaatatgtgctaaaacatctgcttcttctgtcatagttttggaaattccctgtccctcatttcccatgattaaagcaaaataatcatatttagggagattcttataatttaccgattgttcagataaagttgtcgcaatcatagttatcccttctgctttacaaaagttaacaaactgctctatttctaccctaaatactggtaaatgaaagtgactgccttgcatagaacgaagtgttttttggttatacaaatcagcagatttctgagataaaaaaacagcatcaaaattcgctgcatctgcagttcgaaccattgttcctaggtttcctggatcctgcacatcttctaatacaagaaaacgtccttttttaatatctgtccatcttgtctcttgaaaggcaatctcagctacaatcccttgaggagtctgtgagtcagttaattctttcaaaacatcatctgtaacaacaatagctctctcgggttttctcaaacgatctattgccgtttctgtcacaaaaatatttaaaaattgtgcaccatatttttcagcttcctcaaataaatgccagccttcaataagatatgaagatttccgatattttttttgtaacaactttttcgtttttttaatgagattatttgattttgaagttataatagtagtcataaacctattatatcagaaaagaggtcaagttatgaaaaaagttcatttaattgtctcagggcgcgttcaaggagtcggatttcgctatgcaacttattccttagctttagaaataggtgatatttacggtcgcgtttggaataacgatgatggaactgttgaaattttagcacaatctacagattcaaataaaatgacacaatttattcagaaaattcgaaaaggaccttcaaaatggtctaaagtaacttatgttgatattaaactagataacttcgatgattttaatgactttaaaatgagtaattaaaaatcattctgcggaagtattgtttaattcttaaaaaaaaagtaaaatagataggtatattaaaaattagaggaactaaaaacattgaaaaaaacattgaaacgtatcttattctctagcttatctttgtctatgttattattattgacaggatgtgttagcgttgataaggctggaaaaccctatggagttatctggaatactcttggagtgcctatggccaacctcattacttatttcgctcaacaccaagggcttggttttggtgtcgctatcattattgtaaccgtcatcgtacgtgtcgttatcttaccacttggactttatcagtcttggaaagctagctatcaagctgaaaaaatggcatactttaagcctttatttgaacctattaatgaacgactacgcaatgctaaaacacaagaagaaaaattagcagctcagacagaattaatgacagctcaacgtgagaatggccttagcatgtttggcggtattggctgcttgccattactcattcagatgccatttttctcagctattttctttgctgcacgctatactcctggagtctctagtgcaaccttcttgggacttaacttaggtcaaaagagtctgacacttactgtcattatcgccattctttattttgtacaatcttggttgtcaatgcaaggtgttccagatgaacaacgtcagcaaatgaaaacaatgatgtatctgatgccaataatgatggtattcatgtctattagtttacctgctagtgttgcgctttattggtttattggtggtattttcagtattatccagcagctagttacgacttatgtacttaagcctaaactacgccgaaaagtagaagaagaatatactaaaaatcctcctaaagcctacaaagctaataacgcacgaaaagatgttacaaattcaactaaagccactgaatctaatcaagcaattattacatctaaaaaaacaaatcgtaacgccggaaaacaaaaaagacggggataaaacaagcatactaaataatggtgtgttgtcctaaacagttaaagattattatgtaattcaagtaaaaaagacttagttctatgtcctacatagctaagtctttttagttttgcctaacttttcatataaaaagcaccctaaaagtcagataaaaatctagcttttaaagtgcaagtaatctagctaacagactaccttattaataaagtaatcgtttttcccaccagtcttgaataattgcataaagcgtacaaattacccaatagataagggctactaagatataggcggtcatatagtcggagtaggttcccccaactattttagcattattaaagatatcaggtaccgtaatcatcgcagtcaatgaggaactcttgaccatatctagcaaaacattacttaaagaagggagtgcaattcttgttgcttgcggaataataatgcctctataaatcgtcggtgtttttaaccctaaagctctagcagcttcccactgaccatgatcaacagctaaaagagctgctctgataatttctgatatatatgcactagacatcatggtaaaacctacgatagaagcagtcacagcatctaactgtatccctataaaaggcaaaccaaagtagataagaaagagtagaaccattaaaggaatcccacgcattaaggaaatatgaatattagctagatacctcagtaagcggaaatgagacatcttcattagagctacaaagaatcctacgatagctcctaaaataaagccaaccaaggataatccaatggtatatggtaacccctgaataacacttggaaaagccttaacagctagttccaaattaaaaatggcatcccagtttatcacttatctactcctctcgaaattttttatttaactttaattactggaattttatccgttccagcaggttcttttgtgagatcttgaccagcataatatttttcagagatttttttcaaagaaccgtctttcttcatatccttgatagctgcatcaatttttgttttgaggctcttatcttttttactcatcacaataccttgctcagtcggattatacttcacatcacccatttttactttgatatctggatattgttttgttacatattttacagcaatgacttgtgtgtagtaatcattcggaatgaaatctgtacgtccagttgatacatctcgaaggtaaacgtcattagttacattgtcataaataacaggttcagcaccttgctgttttgcaattttcatatattgcgttccagcgccaccaccagcttttttacctttccagtcagataaatcttttgctgtaatctttgaagaaccatctgcacgtacaatcatacctccaacagaatatttataaggttgagagaaattgtattttttcaaacgctcgggagttgtgtcaaagttattgacagcaacatccaccttaccactatctacagaagtaaatgattcagcaactccaacttcaacaaacttaacttttatcttaagttttttagcaatcgctttcatcatatcaatctcataaccagtcaattttttatggtcatcataataacttgttggataaagcgttgcaggggtagcaaccttaaggacaccatcttttttaatattgtcccatgttgtttctttgctagattgaccatttgagcaagctgctaatgtcattgcagataaaccgactaaaccaagtaaaattgtctttttcataagtactcctgtagattaaattatattaaaatggtttggcgtactctatcgaaaattaaatttaatgaaaattaatacataaatttacgataataatacaaccattgttaagagtaccatattgtatccgttttcgcaaaaatattgtttacttttcaaattaatggtaaacaggccctttgaattgcttctctttttcaaacaactctgcaacagcaagcaataaatcttctctccctttagccgctgtcaattgtacacctaaaggtagcccctctttagttagatgagttggtatggctaaagaaggttgccctgtcaagtttggctgatgtgtaaaaggtgtccaggccattgagtcttcaaacattttccaaattaaatcctgttgttcacttactgagaattctcccatatgcctcaattgtttctggagtgtctcgtctaaatcaaattgtccatgaaaaggagctggttgattagttgctgctgttaaaattaaatcataattttcatgaaacctcgccatggtagctgcaaattgatcccatgaatctaagagtttactgtaatctttagccaataccctttgtccactctgatacatagcccaggtcattaattccatatcgctaaattccattgaacgccctaaactcttttcgatgtcatcaaacattgctgctgtttcaacgctattcatcatacaataagttttcatagaatgaataccatctaaaggttgttctactaattctaaatgattccctttttgagacagaaaatctgcggcttctttaatagctgctttagcctcacttgatacctttgtttttaagggagaatccatcaatactgctatttttaggggtttactaacgctaaactcgaaaagactctctttgctgagttttttcaggggaaatgggctttctacttgatatgattgtaaataatataatagtcgttttgtatctctaactgactttgttaaagcaaaatgactagaagccccttgccaacctctataggatgaaggtccaacaggtatacgtcctcgactcggttttaaaccaatcaaaccattaaaacttgctggaattctgattgaccctcctccatcactagctcctgcaattggaaccattcctgaactaacagctgcggctgcaccaccactagagcctccagcatttcttgaatggtcaaatggaagattaacattcccgtgaagttgaccatcactaatattcttaaaaccaaattcaggggtatttgttcttcctaaaataataaaccctaatttttcaaaggactgcactaaatagtccgtttgtttagcatgatagtgtttaaataattgtgaacctgaggttgagagttgtcctttttgattctgtcccaaatctttcagaagaataggaactcctgcaaaaggagcatttgattcatttgcgtatttggctgcttgacgcgcctcattatattgcttgctgacaacagcattaacgcttacattctgttcctcgatcttgtagattgcttgctctactaattcttgcgacgaaatcttatgctgttttatcgcttgtaccatagcggtagcatctttaaaaaccatataaacacctcataaaatgtatttttattataagataacaaaaaatacttaaaaaaatagaataacgtctagactctagatattattctatgatttatactattaatttgttttttcaacactaatgatttcaacttgatagctaccagcaggtgattcaattgtagctaagtctcctgtttttttaccaattaaagcatgagcaattgggctttcattcgaaatttttcctgaaaaaatgtcagctccagcagcaccaacgatatggtaagtatctttatcatttgtaccaacttcttggacaaggacagttttaccaattgcaacctcatctttagcaactgcatcactatcaataatttcagcataacgaatttttgtttctaaaatttgaatttgaccctcaacaaatgcttgttcgtcttttgctgcatcatattcgctattttctgataagtcaccataagaacgagcaatcttgatacgctctacaacttctggtctacgaactaattttaactcttcaagttctttttcaagttgatctttttccacttgtgtcattgggtaagttttttctgccattttatttctcttttcttttcattttttcaagtcaaagatataaacatgatgactcgcaccatgtttataagcttagttaatttgactattgatatatttttcaacgttagccttgtgtgtttcaaaatctttagcgtagtatacatttccggtcttcacatcagcgacaaaataaaggtaatctgttgaagcaggttttatagtcgcttcaattgctgagatacttggactatcaactggtccaggcatcaaaccagtattagtatagatgttgtatggtgatttaattgaagtattaatttgagcatcttcagctaaacttgttttatcacctaatttccccatagcatacaaaattgcaatgttactttgaagagcttgaccggctgataatcggttataaaagacacttgctattttacggcgatcttcgtctgttgatccctctttttcaacaagagatgataatgtcaaaacatcatttacagacatattcttcgctttaatagtgttatagtaaggtgccatcttagtattcattgttgaaatcatatcttcaacaagtccttctaaggttgtatctttataatagttgtaggtagctgggaataaatatccttccaattgataaatagcttttgatttatcaggtaaacttcctagtaaatttggatatttagctaccatttttttaataaacgtttcatcttgaacaagtttcaagaaatcatcagctttataaggtgtacttgtagtctttgtatcaattttattagactcaatagctttagcaatctgtttaatagtgtaaccctcggtaattaatatcttacctaaagctggttttgtcggttctgcagttccgcctttttccaattcagcagcaatctgatctaaagtcatactttttttaagattgtagtatccactttgaaaattactatagtttttgaacttggaatagtaattaaagactgtggcgctcttaatgactcctgctttttctaaaatttgaccaattaatttattcccagatcctatcggaatttcaacttgtacaaatttatttgaattggaatcaacaggtttaatagcactatctacaaaacgataacctacaaatgctgtcaagagcaatacaagtatgataattgatatcagaatacgtgcaattcgttttgccacattatctgctttctgacgtctttcacgcttgttatgtttgttcttggctgacaaagctataccctcttcttcttttgacaaatcctctactcggataggttcctttgctacgggctctaactctgatatctcaccaagttttacattttcaccttctgtaggaatatctgttgctctcacaagaaagatttcttccgtttcttgattaggcacagcagttgcaacatcagtcttatctgcttttaaatctatgtcaggtacattttcagttgtcctaaattcactagatttggagccgctatcaagctctcttgaaggttccatcccttgattgataacttgttcttcttgggaagctaatgcttgttccgcctgacgtctttcttcttctcgagcagcttctgccagaagtttcgcctcaatccgagccttctcttgctcttctaagcgttgcttagtctctagcgcctttgctctagcttctcgttcgtctttcaaacgttgcgcttcataatctgccatcaattgtgctgttctgcgagcagcttctttggcttcttgctctttttgatagagttcttcttcacgcaactttctcaaacggttagcttcttctaactctgccagaatttgttctttaaaacttttctgatcatggttagaatgctgatcgtcattaaattcggtcaaagagatttcctcctaataataatcacaggcaattatatcttaaatagtctataaaatcaacaaaactttgacaatgttatctacttttaacaaattgatcgtgttggattattccaaatcatattataccaaagcgaaccaccatgtttggagtcagattctccctcatctttaaatccattcatttcatagaaggaaattaaatcatcatggcaagttaaacttataccatctcgttcttgagaaacaaccaggtctttcatcgctgctaataatgctgtaccaatcccctgacctttaaaatcaggatgtattgatagactagtaattcctatgaaaccacctacccttacagggaattcagaaactttatggaataaatcgtccgttaagtaccgacctttaataaccggtccttcaatgtaacctgctaaacgaccattaatctctgcaactaaaaaagtatcagtcattatcgttaaacgttcttgcattgcttttttactcgcagcctctgcttctgaaaaatttatttgttcaatactaatgacttgctgtaaatcctctaggcaaccatttctaataatcatactcatctccttaatttctttatgaaattctcttgataaagtcagatagaggactgagaaacttctctcagcccttaccatcaacttattgtgtatttttagttaggttagctaataattcttcaaaagagcgctcatacaattgaatgtctccagcacccataaagacatagacagcattatcatgattgagtaaaggcgagacattttcgactgtcactaaatctgagtgtttgacaatcttagcagctaaatcttctaccttcacctcaccattatctacttctctagcagaaccatatatttgagcgagataaacgctatccgcttgactcaaggcatgggcaaattcgtctaaaagagctatcgtacgagtgaacgtatgcggttggaaaatagctacaatttcttttgacgggtatttttgtcgagcagcatctaatgtcgcaataatctcagtaggatggtgagcaaagtcatcaataatgacagtatcgtcaataatcttctcagtaaaacgacgctttacccctgaaaacgtcttcaaatgctcagctactaatgccatatcaattcccattatgtaaaggttagcaataacagcagttgcatttaagatattatgtttaccgtatgctggtacatgaaactgaccaatttcttcttggttatagaaaaccttaaagtcagaaccattaacagttcgagtgatgtcttttgctataaaatcatttgaatcttcaaaaccataataatatattggtgcctcagaagtgatttcatgaagttttggatcttctccataaatgaataaacctttttgaacttgcttagcatagtcattaaaggcattgaatacgtcctctaagcctgtaaaataatcaggatggtcaaaatcaatattggtaataattgagtattctggatggtacggcataaaatgacgttcgtattcatcagcttcaaacacaaagtaattagcattagcagaaccacgtcctgtaccatctccaattaggaaagaagtgtctgtaatattttttaaaacatgagctaataaacctgtcgttgaggtttttccatgtgccccagctacacctagactagtgaactgacgcataaaatctccgagaaattcatgatatcgtttaaattgatagcccttttcaataacataagccaactcttcattgttatctggacgaaaagcatttcctgcaataatctctaaatcctcactgatattattcggtgagaaaggtaatatagttacacctgcttgctctaaaccacgttgggtaaaataatatttgtcaacgtcacttccttggacgttatgtcccatttgatgaagcatcagtgctagggcactcattccggatcctttaataccaataaaatgataagtttttgacatggtctctccttaattaatgtctttaaaacgtgtcagatttaattcttgagccttggctctttctttatgaaactgattgtcttgtttattgtaaacttgactgcgtttcaaaaaatcaaaattatttttctttgtttttgggttcggtgtattatcaggttcttgaaatatgattggaatttctgctaatatatagctttcctgctgtaaacgatcagaaagatgacttagttcagtcacctttcgctgagtttgttttttcggtactgttgccttcaattgttgctgaaaagcttcctttgatggcgccttaaattcctgtttcgcatagtaagcttgtcgtttctcccgaacagacctctttgcctcttgtcgagatttgctcaactctgtcgctttttttacaaaactctgcggtggtacaggatcattttcaattaccttaggatgtgatatttcttcatgttcataattgcttttgaccatgctttgatatgttttttcttgataaaagtctcgaatgttgttaattaaatcttcattatcataaagattcatctttacaagcggagacattactggttcatcatctgctatcaacggaaatcgtctagagcctctattcacattatcacttcctttctacaacagacctattataaactaatttttctgttttttcaaagttttcaactaagtaaagcttatcagattggtatttttcattcatttatataaaaaagaaagcgagagaccactttcttttttatattatagtcacatcatcatatttatttagaaactccaagtatctctcgaatatcatctacgctcatgctagcatgggtttcatttccatccagaactgttgtaaccaaatgttttttagtttcttgcatttctagaattttttcttcgattgtgcctctagtaatcaagcgataaacctcgacattctctttttgccccaacctatgtgcgcgactaatcgcctgcatttcaacagctggattccaccacaagtcaatcagaacaacggtatcagctcctgtaaggttgagaccaacgccaccagcttttaaagaaatcaagaaagcatcttttgatcctgcattaaatgctctggtcatttcatgacgttcatttgctggtgtagaaccagtaattttataagttgtaagccccatagctaccatctcacgttctgcgatatctaacatacccctgaactgagaaaaaatcagagcacgatgtccattttccttaatttgtgttaaaagttgacgtaggctttctaacttaccgctttcaccatcataatccataaaaagacgtggagtgtcacaaatttgacgtaatcgtgtgatgccagataaaatttcaattttacgacgatttaagtcagcgtcactagaatgttggatactttcttgaatttggcgtaattgcgccaaatagataactttttgactgtctgtcatttcatttggatagttcatttcaatcaaatccggtaattctgggagaacttcttcttttcgacgtctcatcacaaatggtttgatataacgagcaacttgtttagggttcaacttcaaaaactctttcttaccaggtaataaaccaggtaaaatgatctggaaaatggaccaaatttctaacagtttattctcaataggtgttcccgataatgcaaaacagtttttgacctcaaaagatctcaagctatgggctattttagtttgagcatttttcataacctgtgcttcatccaaaattaaataatcataatttccttcagaataagtctcaaaatcctgcctaaatgatgaataacttgtaatgattacttgatgacgttcagcaataatttcatctctacgaatcttagaaccataggcaactgctacatctacgtctggcgcaaatttgtggaattcatcttgccaattataaattaaacttgatggtgataaaataagcacacgagaatctctagttagttttgtacttaaaaatgaaatcgtttgaagtgtttttccaagccccatatcatcagctaaaatccctgcaaagccataatgatctaacatacttaaccaacggacacctgtaagctgataatcgcgcaaggaagctgaaacagatagaccaggtattttaaacttttctgggtgtctcaaatcttcaatcaattggtaaaaatgttgtgaaaagctaacattatcttgatttgcaaacagttctgataattgaaatgctgcaatattatctaattcaatatgcccattctttgctcgtctagctctcaacccttgcaaagttgcacttactttcttagtttcttcatcaaaaataactaattgccctgatttattcacaaaataaggattattgtcaaacaaagctaccagagcttgatcaacatcgttttccagtaaatcagagaaatcaaaagaaatatctagcaggcttcccttagcttcaatatcaatttgcggtcgttctatgagacgataactttccaattttgcggataagctcactgttcccatttttttaaattgtggaagcatataggtataaaaatcgtataattcttgtgcactgtatgctggatggctggttgaaaagtggggtgcaaagccatatttttctaagagtttaaatactttttcttcatgtttgaagtgactagcaaatgttaactgttctagttcttgacgattatgaacagttaaatcattaccataatcaaataccatttgcaataaaatttcattttgactattaatatcgaactcaaaatttaccttaaaatcatgaatagagaagctccgtggagcatccactagtccaatctccttaaaatccagtaaatgagctgctaacttatcttgatcatctaaatcaaaatggatatgttttgctaaatctccctcaatgggaagactacgaatagccgttaccatcttttcttgcttcaaattaagatggtagaaagtatcgcgataaaacaaataagaattcgcaaatagtggttttaagtctttctctttgatttctaattcaattgattgcctatggacaataaccttaaattgataaagatgatcctcaccttctaattccttaaagtagaggtgattaaattgatgaaaatcactttcaaatgaaaaattttctaaagcattcatcaaagtaacaccctcttcaaaaaaaccacgagtgagactaaggtgacgaccttgatttggtaaaataaactctagatcaattttgcttgaatgacttggaatgagcctccataaaaattctatcaattcttgactggtctcatcaaactgtattaaagacaaagtttcaaagtattgttttccaatctgataataagcttcttttcgaacagtatttaaaaaggctttgatgtcacgaataacataacttctatcatcaggcagtcgtctaatttttaaagtccaccagatatcattagcataaggattttgttctccttgagccgataattgatattttatagtatcatcttcattaataattagactatctaaaaaaacactaccaaaagaggttttcttcttagtttcttgttgactttcttgttgaacttgaactttagataagattgctttaccttctggatcgtttttcaagaaatgctccagagcagctaaatgttgacaatagccttttcttgcaaaaaaatcacaagaacattttgtttcttctgttactaatgaatattcaatctgacaatccccaactttagcttttaatagattaccttcttgagaaatcaaggacaccaaaccttgttcgtagagttctataccttgatttcgaatacgtcctggaatcattctactcattatgctaccaccttcatcttatcccttaattataacaaaattcaagtccaatttcttgtaaaaatactaaattgacacgccgtacgcatgaaaactttctcttcatccttttgtgcccggacatcaattttgaaaagattcctttttaaatcaatgatctgcttagcctctttctccaaataattggactaaataatcttccaaatggacagaaatataccgttgtttgcgacgataactgaggtcttttttaggaaataccatcactttgagaaaatataagcacatttttcggataagatttaggttaaatgcggctcttttatccaatgtctgatgatgatcttcatgataaacaacgtccaataaccagtgcatactctctatctgccaatgacctcgtacacaattggcaaatgtgaggacatccggcttaaagctaaagataaaataacgattctcttgactcagctgaccatccttatcaatcgtgttacgagtcatcccaataccacgtaacttatgccatttgggatggttttgacacaaccatttgatatcggaagacacccagtattctctaacttcaatctgtcccctagatttttcaacagtctgataatactgcgcattttcttggagttcttccaataagttgacatcactaaaataaagagcaatatcatcataaagtgtttcttgatttcctttgacggctaagcaatagtctgctttaccttttataatcgtatcaacgatagccgtctgcgtgcccattgcgtctatcgttacaatgcttttacggatatcaattgtccgcaataactgaggaatggcaacaatttcattacttttctcctcaaccgctacctgtcccaaactaagatgatgacccccatcataagccgttacaatatgaacaggcttctgatttttacctcgattgcctcgaatcgttttaccgtccactgaaatcagttgatgaacggcatctaagcttgtcaatgattgctcaaattgaactttaagctcttttaaacggtctgaattaacaagactaatcacacgctctaaggtatcatgagacggacaaccttcactcaaatcaacgtaggtcgcaaacaatggttcattcatttcaataaaatcttccatctccttccaggtttcaatgccagctaactgacaaacaaagacaagaaatagaatggttgataaggggtagcgaattttccaagattgacgactatccaattcaactgcgcaatcatcaatagaaataataaaatcaatcatcgtagtcacctcatctatagtgtactactttgattgattttgtcattatgaatctagttttctgaaaacaaaagtttcttcatgcgtttggcgtgactaaattgattgttttttgatacagtaacaaataaaaaaggctaaaacaactgtcctaaccttctatttcaatttcaacaataagatgttatttacgtttacgtgctattagattaattggtgttccttcaaaaacaaatgcttcacggatttgattttctaagaaacgaagatatgaaaagtgcatcaattcttcttcgttaacaaaaacaacgaaagttggtggtttaacagcaacttgagttgcgtagaaaatcttaagacgttttcctttatcagttggtgttggattaatagcaatagcatccataatcacatcatttaatacagcagacggaatacgtttgttttgactttcgctaatacgtttaatcatatctggtaacttgtgcaaacgttgctttgtctctgcagaaacaaagataattggcgcataagacaagaattggaagttatcacgtatatcagcttcccactgactgacagtatgattgtctttttcgatagtatcccatttattaactacaataataatacctttaccagtttcatgtgcaaaccctgcaatacgcttgtcatactcacgaataccttcctctgcattaatcaccataagaacaacatctgagcggtcgatggcgcgcatagaacgcataacagaatatttctctgtgttttcatataccttaccagatttacgcataccagcagtatcaatcatagtatactcttgcccctggctatcaacgaaattagtatcaatagcatcgcgcgtagtaccagcaactgggctagcaataacacggtcttccccaaggatggcattaattaaactagatttcccaacatttggacgtccaatcaaactaaaacgaataatatctggattttcattttcctcttctaccggaagattttccacaatagcatccaatatatcaccagtaccaataccatgaactgatgacaagggataaggatcccctaaaccaagagagtagaaatcgtaaatatcattgcgcatctcaggattatctaccttattaacagctaaaataaccggtttattggtcttataaagaatacgtgagacatactcatctgcatcagtcacaccttctttacccgacacaacaaacacaataacatcagcctctgtcatagcaatgtctgcttggtgcttaatttgctccataaacggtgcatcaacatcatcaatcccaccagtatcaattaatgaaaacttacgatttagccactcacccgttgtatagatacgatcacgagtgactccttcaacgtcctcaacaatggaaatacgttctcctgcaattctgttaaataatgttgattttccaacattcggacgaccaacaatagcaactgtaggtaataccataattctcctctcactattgggaatactcccaattccattctattttattaacggcgattcggtccttctaagtggaattctatcgctaaataccgtacgcgctccataactcgttttgcttgccaagtttcgtcgcttccttttatattagcccattttctttccaaatcgttaaaactataatttgacgtaaagaaagtgggcaactcttctagcatacgatgttgtaatataacttgtaaaatctcgtcacgaacccaggacgttgcctgttcagccccaatatcatctaaaatcaaaatcggaacacttttcacagcatcaatttcatcttttacagttccgcttgaaatagcatttttgacatcaatagcaaaactagggaaatgaagaagagtcgttgacacaccctttctctctgataattccctcgccattgctgccattaaataggatttcccaacccccatatctccatataaataaagccccttgtgattatatgaaggataagtctctacaaaatcaagcagttgtgacatagctttcattcgactctcgttattaatatcaaagtcagtcattctgatattccgataggacttgggtagattaactaaattaatacgatcactgatagcttgttttttttgtgcttcaattaactctcgtgtttctaaataagaaacatctgcataaccttcattcataaccaaaataggctcatagcctttagcaatatattgactatccttatttttaaatttctgacgctcaatcaaaaattgattaaatttagacatgctgatatttatttcacgctgagaaagttggtgggttttaatgaactccgctacctgagcatctgctaaaatcatttgaataagctcatcatttgtattacgaggcactctcccttgattttctaatgcttgtcccactgatttcatgattcaccatcctttcctaatcgttctaaacgcttgagggcatctgttttaaactgttctaattcaatttctttttctgggctaacctcatctttataatcaggattactccattcaggaacattcgattgtttcttcttcgtttctgttttagtccttactttttgatctgaaaaatcacgaattttaagcacagcatcttcggccgtcataacattctgaaaagcaaaatcattagcaactttcatgatataggccttatttaagttagcagattttgtcttattcaaggtatataaaaccataacattaatgacttcgtctaggaaattcatttttgccaaatcctcaagtaaagtcttctcaccacttgttgtcactgccttacggcttctcttgattttttcaaggaacactagagcactatcatttttagattcccttagtatgaccttttcattatttgtaaaactctgattatctttaatatgctgcccctcattttgttgaactttcattcgctgaggcgcaatcattccattgatagctgtttgttttgctaattgataggtatcataccaatttaaatgataaagttctgatacactataaatacctaagacatcatctttttcattgttaaaacgtaagccatctcgcatcatcaaacgtttgaaactttccaagtcaaaaacatttttactccggtttacctcttgttttggttgtcctaaatccgagaaaacatctgtaaattttttagagatatctctagcatttttaggtattttcatatctaattctgccactgctacctctcctatacgtttttctaacaaacgacgatagatgggattagataaaaataactcatttgacatagcttgattcaacttaacaaggtaagtacctgtggcttggtaaacagtcaacaaatccaaagctgttaacattaccaatgcatcttgaaatcttggcatcccgtattgcagatgattgagaacctctgaaaatttatgacgtcgtattccgtcatcaaaaaaatgaacaaaataatcatagagtgccatggcatcacttcccataattgggaaatacaattgtattaaactattactatcataaacaatcttattttgcttaatatatgtaaactcatctattggactcatcacacgctaccactctttttactccgtacgcgctttgtaatttgttgaagtagttcttcaatttcatctacatctttaaaagatttataaacactagcaaagcgcacataagtaatctcatctaattcggcgagttcatccatcactaaatttccgatagtgatactagaaacctcatcttcatactcactcctaattttacgttcgatacgtaagatacaattttcaatatcttcgctcgaaacagggcgtttttgagcactctgaataataccattcaaaattttatctcgagaaaattgctcgcgagtaccatctttctttatgactaaaagaggcaattcttccaaacgttcaaatgttgtaaagcggttgccacatttttcgcactctctccggcgtctgatagtcgtaccttcttcagcttgtcggctatcaaccacactagatttattatagccacattttggacaacgcatgtcaacacccctattctatcatatcatttaatcatcttattttaacacaaattcagtaataacaaaagaagcgcctctcttatcacctcatcatatcaaaacacaaaataatccttatgccttttatcattaagcataaggatttttcttatatttctttagtttcttcaaatttttttataggaatgcgaacaatgaattcagtcccttgatttagttcacttttaatatccacctttaaatggtaagcatccataatttgtttaaacactgaaagcccgatacctaaaccagcttgtgtactttctctgttacgtgatttatcagttcgataaaaacgatcaaagataaactcaatatcttcatctgagataccttctcctttatcttttacaactactgtcgcaaaatcattgtctactgataaaacaacactgacttctttataactaggagagtacttgatagcgttatcaattaagatcatgagagcttgctcaaaatgtatcttatatatctttccccaaacgatatctgaaatattattttcaaaaataaattgaaaatcttctctcaaaatacggaaattttcaataacaactgatatagagcttgataaatctgtcacttcatcttgatgaagttccaagcttccttggacgcgaatcatatttaacatgtcattaatcattaaggacatacgatctgcctcatggtatgccgctgctaaactttcttcaagaatttctggatcatctttcccccaacgttgtaataaaccaatatgaccctttacaacagcgacaggcgttcttaattcatgactaacatcactaatgaattgtgattgtcgacgagtatagtcttccaactgatccaacatcccatcaaaaatcctagacaattctccaatttcgtcttctgaacggaccttacttctaatttctaaattactaggattttcagatatctgatgcattaagtcgtgtaaatttttaaccggacgaacaatacgcttagtagcactattaataacgaccaaggctaaaacagtccctaaaacttccatcataatcaagaaaacaatgatgttttgcctcatactataataacgacctaaattatagaaaatttgaacgtatccaagcaactgtcctgttttttgagagtagattgcttttgtaccaacaaaaccttccatatctgcaactttagagatgataacttttcccatggatttaccaatagttggcatacccgttctcagtgtagaaaaaactggtttcctgttgacatcgtatagggtcatttcttgattaacataaagaatactatcgattgactcgcccgttctaacaattccattttgacgcttatgaggatagatgtcatccgcaaaaacctggttgtacaggatctctaaaatatcatcggatgtcaaactagagttcgcttgcgacaaacgaactctagttttttctaatgacctaccgacattaattttttccctgtgaaggacgtatcttgttgccgaagtataaactaaaacagaaaatactgtaaataggctaaaaaataagataaaaactaattgcgataatttttttgacagaggttgttttacccctataaactgatcttttttatttttcacgaatcacatagcccattccgcgaacagtttgaatatatgattcacgacctgggatatcaattttacctcttaggtaacggatataaacatcaacaacgtttgtctctgctgccacatcgtatttccaaacatgttctagcaactcttctcgtgtcataacacgattcatatttgtcatcaagacattcaacaaatcaaattcacgttttgttagtgaaatttcctcatcaccacgcatcgctgaacgattatgagtatttaatgacaaatcacggaaactaccactatcacctttttcttttgtcttcgtttcaatttcttggcgtcggaaaatcgctctaacacgtgctaataattcttcgattgcaaacggcttaacaatataatcatctgctccacgatcaagaccagctacaatatccataacagaatcacgtgctgtcatcatcatgatataggttgttttttcagcctgcaggcgacgtgtgatttcgaaaccatccatctctggaagcattaaatccagtagaatcaaatcaaaatctttttctaatgctgtgtccaatccttcacgaccgtttgtttcaacaacaacatcatatccttcatgtagtagttctaacgagacgaagcgagctaaatttttctcatcttcgattattaagatctttttacccatctacaccaaccttcttattctttacttaacactatcaattattttttagaatatctagataaaaaacaagatagcccacattttactaacgtttctttaaataaataaatcgccatcccaaacaattgttcgatagcgagacttaatttttattattgagtagtgtcctctgtcacttttcaattctactaaaaaaaaattaaaatatcaactgatgttattaataatttttatctaatcactatcaaacataccttctaaggctgcgaaaggattagatttttctttttctttagcttgtttttcttcatactgcttttcagtcattaacgaccaatttttacctgataaatccgcttctaccccaacctcatcagctgccagaacacgaagaggtatatttaacaagatattatcgataacgctttcttctaaattaatatcatcttcctctaatattaagaccaactcctgatcaacgagctcttttttagtgctaacattttcagcttcaataaaaacttcattaatagtttgcttttcagataaaacaactggtttcatagaacgactagacggtaatgtaatatcgtaagccatattatagtcaagtagatagagaccatcttcatacaccacatgacctgaaacttgaatatcagaaatatccattatctctgaatgacgctccataagcgactctttgatatctatttttttatcaaaataaagcccctctggtgattttttgatttctgtaagtaacacgtgccatctccctttatagtatatgtcatattatatcaagttttacaggctttgtcttaaaaaaacaaaacgcaaggcatagctaccctacgttttgttaacgactacatatgacgcaaacgctcaatacgatctgcaattggtggatgcgtataaaataaagactttaacccttcttttttcgttgggtcattgatatagagagccgcactagcatcatctactggatgccccataggttcagaacgatcaagtttttctaaagcagagatcattccttgtggatttcttgttaactcaacagaactagcgtctgctaagtattcgcgctgtcttgaaatagctaattgaactaaactagcggctaatggtgcaaggattagtgataaaatagagaaaatcaaaaccaagatgtttccaccatcttctctgtcatcatcacgcctacgacctccgccgtaaaataacatacggctaccaatgcttgatattagagttacagcactcgctaaagctactgcaatggttgaaatacggatatcataattacgaatatgactaacctcatgtccaataacaccctctaactcttcgcggttcataacagctaataggcctgtcgttgctgcaacagcagcattttctggcttagagcctgtggcaaaggcatttagggagtcatcttcaacaatgaaaacgcgtggcataggtatctgagctatcattgccatatcttcaacaatatgaaaataatttggcgcctcatcttctgtaacttcacgcgcattgttcattgacataacaacattagttgattgaaaaatcatacttactgcatagataaccccaataattagagctagaacaagcccaaattggtagctgcctaataccaaataacctacagctgctccaatagctgctaaaagacagaagaagacaattaacaagacaactgtttttctcttattacttgcaatttgttgatacagcaaaagcctctctcccttctcaattaaaagtcaaaggaaacttttggcacttctttttcttcttcaggagtttctaagaattggcttggtttgaacccaaatagttttccaacaatattacttgggaaagtttctaatttcacattataattggatgttgttgtgttatataactgacgtgaataagaaattttattttccgtattagttagttcttcttgaagtttaacaaagctattgttggcttttaaatctgggtaattttcagcaaccgctaaaatacttgaaagctgtcttgttagctcattacttgctgtcattgcttcagcaggtgtgttagctttagcaacttgagcacgcagttctgcaatcttctcaagtgttttcccttcgtacgcagcatagcctttaacagtttcgattaggtttggaattaaatcgttacgacgtttcaattgaacgtctatttgactccatgattctttagtatgcatgcgacttctaactaaactgttataagcaacaatcaaccaaataacaaacaaagcaataattgctattaaaatcatagttcccatagtagtagctcctttacattttttccattatagcaattttctttagattaggaaagtcctgttattcccattattagtatttgtgataaaatagagtcattatacgatatagaaattgaggtttactatgacaccccaagcattttatcaagttctgatagagcatggtattacacttactgacaaacagaaaaaacaatttgaaacttattttagacttcttgttgaatggaatgagaaaattaacctaacagctattacagataaggaagaggtttacttaaagcacttctatgattctattgcgccgattttacaaggttatattgacaatagtcctcttagcattttagatattggtgctggtgcaggttttcctagtattcctatgaaaatcctttatcctgaaattgatattactattattgattcactgaataaacgcattaattttctaaacatattagctaatgaacttgaactttcaggagttcacttcttccatgggcgcgctgaggactttggtcaagatagagtatttcgagctaaatttgatatcgtaacagctcgtgcagtagctaaaatgcaggttctagcagaattgacaataccttttcttaaagttaatggtcgcttgattgcactgaaagctgcagctgctgaagaggaattaatttctgcagaaaaagctttgaaaacactattttcacaagtaactgtaaataaaaattataagttacctaatggtgatgaccgaaatatcacaatcgttagcaagaaaaaagaaacgcctaataaataccctcgtaaagctggtactccaaacaagaagcctttgtaaagttgggagctagtatgaaacatttctttgattacaagacaatgtctgtcgcacgtaaactcagcattagttttatcgctgttatcctattgggaagtattttactttcacttccaatttttcaatatgctaacgcccctaaaacacattacattgatcaccttttcacgactgtttcaatggtatgtgtaactggtttatctgtttttcctatcagtaaggtttataacggttgggggcagattgtagctattttactcatgcaaacagggggacttggtttagtaacactaatgtcgttgtcttactataccctaagacgtaaaatgtcgttaaatgatcagacccttttgcagtcagcgataacttataacagttcgacagatttaaaaaaatatctctatatgatttttaaagtaactttaactttagaagttttagcagccagcattttagccatagattttattcctcgatttggtttgggtcatggtatctttaatagtatattcttagctgtctcagccttttgtaatgccggttttgataatctagaggcaacgagcttagctcaatttaaactaaatcctttggttaacattatcgtttgtttcttgattatttcaggaggacttggatttgccgtatggaaagatttaattgaagctactatacaaacatctcacaagggaccaaaattaatcaagacatttccaaaacgcctcagcaaccattctaaactggttttaaaaacaacaaccattattttactaacaggaactttgctttcttggttgttagagtttggaaattttagaacaattgctaatttatctctacctaaacaactaatggtcagctttttccaaacagttacgatgcgtaccgctggattttcaactattgattatacccaaactgatttcgcaaccaaccttgtttatattatccaaatgttaattggaggagctcctggtggaacggcaggaggatttaaagtcactgttatcgccattttactcttactatttaaagccgaactgagtggccaaagccaagtgacttttcattatcgaacaattccttccagtattattaaacaaacactatcgattttaactttcttttttatcatacttattagcggctatctccttcttctggaactcaatccccatatagatcctttttctcttttctttgaggcatctagtgccttagcaaccgtgggtgtaacaatgaacactaccaatcaattaactctgggcggtcgaattgtaattatgttcctcatgtttattggtcgagtcggtccaattaccgtactgctatcaattcttcagaaaaaagagaaggaaattcactatgctgaaacagaaattattctaggttagaaaaggtcttttatgaaaacaaaaattattggtgtacttggtctaggaatatttggacaaacactcgcacaagaactaagtaactttgaacaagatgttattgctattgacagcaatcctgaaaatgtacaagctgtcgccgaagttgttacaaaagcagctatcggagacattactgatttagctttcctaaaacacatcgggatcagtgactgtgatactgttattattgctacaggaaacagtttagagagctcagtattggccgtaatgcactgtaaaaagttaggcgtcccacaagttattgctaaagctcgaaaccttgtatacgaagaagtactttatgaaattggtgctgatttggttatctctccggagcgagaatctgggcaaaatgttgctgcaaacctcatgagaaataaaattacagatgtcttccagattgaatctgatatttctgtcattgaatttaaaattcccaaatcatgggtagggaaaactgtcgaacaattaaatatccgtcacaagtttgatcttaacctcataggtatcagaaaagcaaaaaacaaacctgtcgataccgaagttccaatcaatagtccacttgaagaaggtattattctagtggctatcgctaactcagatgccttccaacgctatgactatttaggatactttaactaaagaaaataaaaaactgactattaaggtcagttttttattgccatgggttatagaaacgtccatgattaaggtgaattaaataaaggcttacaaacagactagctagagcaagtatgattaagacaatgtcacttttttccaaagattgcttagagtaccaagtacgtcttttatttttaccaaatcgtcgaagttccatagcagttgctactgtatcaatacgttctagagagctaaaaattaatggtgtgacaatctgcaaattccccttaatgcgtgctactaagttcgatttttttgataattctattcctcttgcctcttgtgctcgacgtattgtataaaattcttcttgaacatcaggtatatatctaagggtcaaactaacagcataagctattttatatgataaacctaattgatttaaacttgatgcgaactgactaggattagttgtcatcaaaaacaaaagagctaaaggcactgtacaaaagtattttaaaatcagattaaagaggtaaaacaactcttggctagtcacatcatatgggccaattccttttaacaataaagaagaactaccataaatcttatcaccataatggggagcaaaaagatagaccattataatatttaaaacagcgaatacaacaactaaagtcataacaaaggacacctgttgccatttgatttttgctaatctaaataagactagcgatcccaatgaaacaacaattaaaaatcttgtatcataagtggtcatgcaagcaacagaaactaaaataaaaaatagtaacttactggcacctgatagcctgtatagaaagccataaccctcttgataaccaattaattgtttagccattcttacctccttgattatcaatgtaccattgtgttagtttctgtggagatatccctaatctgtctgctaaagcaaataaactcgttttctttaaatgagtctttttcaaaagctctgtatttgaaaggatgttaataggatgatcatctgcaacaatcagaccattgtcgattacaattgcacgatctgtatactctaacataagctgcatatcatgtgtaatcataacaatggtatgtccatcacaacttagtttatcaaggaaagacatcatttcagtataatgcttcatatcttgaccagctgttggttcatccaaaataataacttctggatttaaaatcagtatcgaagcaatcgtaacacgttttttctgaccgaatgatagagccgatataggccaattcctaaattggtagagcccacaaacctttaatatatcgtagacacgactttctatatcattatcactaaaacctcttaaacggagacccagagcaacttcatcaaaaaccatcgcttgacttatcatctgattgggattttgcaaaacatagccaattcgttctgctctttcttttatagagtcttgactgacatcttcattattataaattagagtagcattattagggataaattgacataacgctttagctaaagtagatttacctgcaccatttttcccaacgatagctaaccgctgacctttatataaatcaaacgaaacatcatctaaagtattattctctaaatcatatgacaccgacaaatgctgtactgataataatttatctgtatgtttatctaaatctaatgctcgcattttaggtatcaatagttcactgaaatcaaagtcatcaatagacgtcattgtattttgtttttcaaagtcatatcctaaatttttgagagcagaaatatacagtggttctcgaataccatattcagataaaaaattagtttttaaaagttgatccggctccccattataaataatttgtccatcactaaaaagaactacacgatctactcgctcataaaaaacatcttccaatcgatgttcaataataatagtggtcgcatcttgctcttgatgaatacggtcaaccaatgccatgatatcttgtcccgattgtggatctagattagccaaaggctcatcaaataatagaattgggctatcgtctactaaaactccagctaaactaacccgttgtttttgtcctcccgacaagtcttgtggacgtttagacaaaagaggagctatttctaaacgttttgcccacatttcaacgatagaggccatttcttcctgtgctacaacatcattttctaatgcaaaagcaatatcttctgctactgtcaatcctataaattggccatctggatcttgtaaaaccgtagaaactaaatgagacttgtcatatattgacaagtcaaaagcatttttatggttaatcgtaaaaataccactatattggcctttatgagtatttgggataataccatttaaacaatgaccaagcgttgacttccccgaccctgaaggtcctaatatcaagaccttttcacctttaggaatgcttaagttaatcccttttaaagttggttcagattgaacgtcatattgaaaggtaaaatccttccattcaataaaatctttcatagattactctcttatcctaatctttggataaactacctttttgtggtcgtgatttagcgtatgctagcaacaaaagcgtaccacctactccaatagtaatggaattcacaaggcttgataagaaaccttgtgcaaaaactttgcttgcaggttcgctataaaagaaaatatcaccatacggtgcaacgacagaccaacctataaggttagcaataacttgaactacattaaatagaagcaaatccttcttagtcatgccagataattgaatagctaattttttagcaaaaaagcctatcatcaaacctaaaagaccactaactaaaacccaagtccaccacggagaaccatattgaatcgaatctttcaatgcgtgtccgataaaaccagtaaaaaaaccaactcctggtccataaataactgcaaataatgctaaaactgcatactgcaattgaatattagtatttggaattggtgttggtatattaactagcatacctataatgataaaaagtgcagctccaattccagtcgctacaaccttttttattgtgtttgtattcataaaaacctctctgaaaaacaagcttaaacagtcacttacaatctgttctattttatcatatttcaagctgatttgaaaccttattgacaagaagaactgaaaaacgattgaaaataatattaaataccaaaaaagatctcagatagaatacctaagaccttcattagtttatttttttccaaaaactgatttttcagctacagccgtgaacagaacgtctgtcgatgaatttaaggctgtctcacacgaatcctgtatcacccctacaatgaaaccaactcctacgacttgcattgcaacgtcatttgaaataccaaataagctacatgccaccggaatcaataaaagtgaaccaccagttacaccagaagctccacatgctgatacagcagcaaccacacttaataagaatgctgttggaaaatcaacagtaattcctaaagtatttactgctgctaaagtcaggatattaattgtaatagctgcaccagccatattgatagctgcaccaagcgggatagatactgagtaagtgtctttatctaatcctaaatcctcacatagtctcatattaacaggaatattcgccgcagaactacgtgtaaagaaagctgtaatacctgaatcctttaagcatcgtaataccaaagggtaaggatttttacgcatcataacaaaagcaatgattgggttaacgacaagagctacaaataacatcgtacccaccaaaactaatattaaaagaccataatcacctagtataccaataccgttttctgaaatgctagtgaaaaccaaccccataataccaattggggccaaattgataatccatttgacaacttgtgaagtagcatcagcaaaagtttgcattaaatcttttgtacgctgattactgcttcgcatcgccaaaccaaaaataaccgcccaaaatagaatactcatataattggcctcggtaatggcatgaatgggattatcaacaattttcaacaaaagagattgaaagacttctgaaatccccttgggaggtaataagtctgtctttgctggcgttttcaatatcagtgtcaaagggaaaatatagttcacaacaacagcgattagggccgctgcaaaagttgcagtgatatacaaaccaattatcgttgacatattggtcttaccgccctcacggtgttgcgacaaggcactaataactaaagtgaaaactaaaagaggggcaatagctttcaaccctcctacaaaaagttgaccaagtaaaccaatcgcagaggctttagggactaaaatacccaagaataagccaataacgactccaattgttattttttttatcaagcttgtttttctccaagcttttaaaaatcgtttcatactaaactcctaaaaaattcttaaactctatgatatgataaaaaaaaagattcgtcaaataccttttttattttttagaggttgacgaattctaaatttttctgatataattactttttgaaatattcaatcaatttcgaaaataaaatatttttttgtacagaaaggtacattgatgaaactaaaaaacacttatatcattatcggcttgatgctttttgcgctgttctttggagccggtaatcttatttatccagcctacttaggtatctactctggttctaattgggcgtgggctatcattgggttctgcttaacaggcgtaactttacccctacttggtgttgcagctgtggcgtactcaggagcaaccgatgttgaaagcttcaccaaacctgtctctaaaacatatgctattttctttgcagtagcactatacctatctattggacctttctttgccattcctcgaacaggggcaacctcattctcagttggtattcaacctatcttaggcgacagctccttagtcaaaattatctatggtttaattttctttggtatttcttatttcttagctattagacctagtcagattgtagatcgtattggtaaatatctaactccctttttactaactgttattagtattttaattattgcctcactcatccatccagctgctatcgttggaacaccacataacgcttcaacgaatgtcagcgatgctttcaaggatttaccattcctagcaggactgattcaggggtatggtacaatggatgcccttgcatcaattgcttttgctattatcgttattcaagcaagtaaacagtacggagcaattaccaaaaaagaaattacttctatggcacttaaatctggtgctatcgctacatttcttttagcttttatttatatttttgtaggacgtattggtgcaacttcacaaagcttgtttaaatttgcaaatggttccttcttacttcacaatactccaatagacggtgggcatgttcttagtcaatcagctaacttctatttaggaattgtgggacaagctattttaggtacggctatttttcttgcttgcttaacaacagctactggattaatcactgcttgtgcggaatacttccacaaattacttccaaagattagtcacattacttgggctacaatctttactttaattgctattacgttctattttggtggtttatcagagattatccgttggtcactaccagttctctaccttctctatccattaactatagtcttaattttcttagtcttttttgatcaaaaatttgaaagtagccgcattgtctaccaaacttctattgccgccactgctgtcgctgctttatacgatgccttatcaaaactcggcgaaatgactggtttatttaccattccatccgctttgaccacattctttactaaagttgttcctttaggtgaatattctatgggatggattagttttgcaatttgtggtgtcttagttggtcttattctaaaaaaagtaaaagcataataatttaaagcagtacgaaaattactgcttttattttaaaataattattgtaaccgctttcttttggtggtataatagccttgaaaataaataatttttggaggaactctaatatgagagctgcaacttatctttcagctaatgaattatcacttactgataaggctaaacctcaagtaataaaacccacagatgcggttgtaagacttgtcaaaacaaccatttgtggtactgatctacatatccttggtggcgatgttcctgcttgtaaaccaggaacaactttaggtcatgaaggcattggtatcgtcgaagaagttggttctgctgtcaatcattttaaagtcggagataaagtaattatttcttgtgtcactgcctgtaatacttgctattactgtaagcaccagttgccttcacattgtgaagatggcgggtggattttaggacatcttattgaaggtactcaagcagaatatgttcatattccacatgcagatggtagcctttatcatgcacctgaaggtgtttgtgacgatgcattggttatgttatctgatattttaccaacttcatacgaaatcggcgtcttaccttctcacattaaaccaggtgatactgtttgtattgtaggcgctggaccaattggactatctgccttactaactgcacaattctattctcctgccaaaattattatggttgatttatctcaaaaacgacttgaagcctctaaaaaatttggtgcaacacacaccattctatcaacgtctactcaagaagttaaagaagaaattgataaaattaccaaaggccgtggcgttgatgtcgtattagaatgtgttggttatcctgcaacatttgatatttgtcaaaatgtagtttctattggaggacatatcgcaaatgttggtgttcatggtaaacctgttgaatttaacctccaagatttatggataaaaaatataacccttaatactggattagttaatgctaatacaactgaaatgctccttgaagttcttgagacaggcaaaatcgatgcaacacaactagtaacacatcacttcaagctatctgaaatcgaagaagcttataaggtatttaaagctgctgaagaaaacaatactctcaaagttatcatcgaaaacgatattactccagcctgataatttttaaacaaataaaaatgtgagaagaatagccttctcacatttttatttatgactcaagcgacgtgttaaaaaatcacctaaaaattggataaagaaaattaataataaaatcagaatagtcgctactaaagtaatatcatcacgagaatagttatatcctttagtaatagcaacagaacccaatcctcctgcaccaatagcgccagccatagctgtttcacctactaaagaaatcaaagtaaccgttgatactcgaattaaatctggtagaccttcacgaagataaactacaataatatcccaaagtgttccacctgaggcttgtgcagcctcaataactccaccatcaagttcagctaaaacaacttgaacttgacgagcaaaaaatgggaaaactgccaaagaaagaggtaccaaagctgctggtgaaccaagtgttgttcctacaattacgcgagttactggcgcaatcaaagcaagaagaataatgaagggcagagctctaaaaacagaaacaactttatctaaaactccaaatactaatttattagcaataactcctctaggactagttaaaacaaggaataaacctcctaacaatcccattaaacctccaataaggaacgaccaaaaagtcatataaagggtttgtacaatagctgtctgccagccgtaagcaccttcccaacccatttgatatacatttggtaaatgtgtttgaatccactctatcatgctttaccaccttctttcaataacgttaattgaacttgcgaatctgtaattgcttggcaggcttgtcttaatttttcttcgtcacctgataagataactaccatttctccaactggaataccatctaaaatttcaatattcccatagaggatgttagcagttacttcaaattctttataaatttgatttaaaagcggctcatccgtgctatgcccagcgtatttcagttgaactaatttgctacctactggtagatttttgacaacttcttgttgctcaatcttaagcattgcctcatcaataccagtagctatttttataaaatcttgtgtaagactctctctaggatgtgaaaaaatgtctaaaactgatccttcttcaatcaatttaccattttgcataacagcaacgcgattagcaatgtctttgacaatttgcatctcatgtgtaatcaaaacaatcgtaagtcccaattttttattcagatcttggagaagggcaagtatttgttttgttgttttagggtcaagtgcagaggtagactcatctgaaattaagattttaggatcgttagccaatgcacgcgcaatggcaacacgctgtttttgccctcctgataattgtgaaggatagttttgagcacgatcggataatccaacaagttctaataatttagcaaccttagctgctttcgcctcttttgataaacctgaatgtttaagagcaaaagctacattctgctctgctgtcaactgtgacattaggttaaaatgttgaaaaatcattccaatttcacggcgctgttcgcgtaattgtgtgctagtcagtgtcaccttgttgtcgtaaataacttggtcatcaatagtaattttacctgctgaaggttcttgtagcaaattaataacacgaacaagggtagattttccggctcctgaataaccgacaattccatatatatcaccttgattaatatggatagtaacatctttaacagcattaatctcacgtttcttttggtggaaagtaacatcaatgttgtctaatttaataattggttctttactcatatgattctattaaagcctccactaattcaatatgggtgtaataatcagcaatactaacattttcatcaacgccatggtctcgactattggcatgtcctatgccaatagctgcaattggcgctcttagagcttgatgaactaaatacattggtcctgtacctggtgaggtaggtaacagagatatcccttctggataaaattgctcagctaaatcaacaacctttaggatagatggcgctgacatatcactacgataagacatttcaccaagggtataggttagctcaatgtctttaaagccattctctttcaaatgattttgtattgaatctagtacacctttcggggttaaccctggtactaacctaacctctgctttacatttagcataagcaggtaaaattgttttgacgccttcaccttgataacctgaggttataccttcaatggctatagaaggttcaaaataaagctttctcaaaaaagttttatgactatctgctaaactgggcaaaactaattggtaagcaccttctagcgcctttgcagatctataagaatatttttcaactaattctaactctctcttagtagggggaataactttatcataaataccttctaccaatatatgacctttgttatcccttaacgtattgagggcttgaattaaataccatgtcgaggaatcaacaaccccaccaaaggatgaatgaatatcaacatccgctgaacttactgataaatcaaaagtgacaatgcctttatttccaccagcaatttccaactgtcctttaggatttttagggccatcttcccacacgatcaaatcagccccttgtagctgctcttgatacttttctaaataataatcaaggcctactgaagctgattcctctgctccttccacaataaaagtgatatctagaggaagttcccctttgtgtcttgataaatattttttaactgctgataaacgtgcggtaatgtgacctttatcatcatctacaccacgtccatacatcttaccatatcgaagtgaaagtgtaaaagggtcctcagtccactgttctacctcatctgctggtacagtatcataatgattgtaaaaaataatacgcttagcatctacttttgatgatttgaaatttgccacgataaagggagcgctatagctgtcatctataatgacttctgcgccagcttttatgaaaacttctccaagatagcttgataagtcatttaaaccaactttctgagcaaaaattgacttaattgcaattaaatctcttaaaatattgatatcatcctgaacaatagtatcagatagaaacttttgaatttgattttcttcgtttgttaaagtcatctttcatccaccttccttcaaaaacaatccaagagcctggcacattgtattcgtcccaggccctttatggctatatggctgataagttgtatcctattaggattccctgttaaacttatacagtcaattcacgttaccattgtggaatatcagctgaagtatctttgataacttttttcacttcatctgtgtgataagcatccaagatagcttggatagctttagcgttcttttgctttttccaatttttacgtcccgcaatgatattaatccattgttttgaatttttatctgatttctcaacaaagatagcatctgaaggttttaaattagcttgctcaatgtatgtattattaataatagctgcatctacatctttgagtgcacgtggtgtttgactcgcatctaactcctgaatattaatatcctttttattagatgtgatattagcaactgttgcaaccttcttaccagaaacattcaatttgattaaacctgctgactgaaggacatacaatgcacggctaccatttgttgcatcatttggaattgcaatagtggctccttttttcaattttttaagagattttaccttctcagaatagatacgaattggagctaagtaagtcttttcaagtggaattaagtttttcttattttccttattccagttttctaagaaattgtaatgttgaaaggcattaatatccacatccttattggctgtcgcttgatttggttgtgtataatctgtaaattctgtaaatttgattttagctttatcacctactagcttttcaattttatcccaacgtgctttttcagtgtcagaaaaggtcataacaccaactttaacaactttacttgaagttgagcttgctgaaacttcttgattactaaatgtgactcctaaaagtgttgttaaggctaatcctaagacaatatgttttaacttcataataaattccctcaatttttgtgataaagatattatcccataggaagttattagaatcaaattgttataaactgtctcttgttatagttttaaactatataacaaaaaactaaggattgacatctccttagtttttattactacttctccttaggagtaacgagatctttctcatttggtacgtaatcacctccaaggtattctttagctatttttgaaagtgtcccatctttacgtaattgtttaaggcgattattcacatacttttgcaagtctttttgatcctgaccaaagatgaaataaatataaggctgatctctcatagtcaaagggatggtttttaaattcgtgagaccttgattctttatgatagcgttaacagttggtccgtcaaaaagtttaaaatcagcttttccatcactcaaattcgttagaatctgtgtaatattttcattagtatattttagagtaacaggatttttctgatgctctttattgaaattttctaattgcttggcagttgtcgttccttggacaacctgtgttttatgaccactaatatcattataagctttgatattactattcttaggaactgctaaaactgaaggagtagagcctattgggtatgaaaataaatatttttgagatctctctgatgaataagaaatattatttccacccatttgaaactttcctgaatcaatgccggtaaataccgatgaccattctgtttttttaaaagtgactttatagttatctgaacctttaaaaacagctttggctacttcaatatcaaagccagtcagtttcccatccttcacataagaaaaaggtgccgttgttccaacagttgcaaaattaacttcttttttgcccgtcttagtagtatgagattttgagctacaagcagctagagacgctactgtcactaaaataattcctgttacacttaacactttttttattgtcatcttttttctcctctttaattgtacacgacatcataacatctttaagtttttaactaacacttatcttctatcgtctgagagtttttgctattatatggatgctacgtttcattaacaaaataaccaaataaggtttggttttcaatttggtgaagcattaattctggatgccattgaacacctataatacattgttctgttcgactttcataagcttctactgtcccatctctaggatctctagcactaactatcagaccttcagctaacagtttaacactttgtctatgaagagaattgatcttaaaatcacctgatataaagccttctagaaaactccctttttccacatttaaataatgagcaaatccaatgtaaggctcttgatagtgattatcaatagattgattaagtgtaccaccaagcgccacatttactaactgcatgccacggcaaatcgcaaagattggtttattttgtttcaacgcttcttcgactaatgcaaattcaaaaatatcacgcgcaagtgaataatcatcactctcaattatcttctcttcaccataataggatggtaaaacattttggccaccagatatgatcagcttatctatcatctcaacataagctttggcactttctgcttcacttattggtaggataactggtaacccgcctgcgtttttaactccttccgaaatatgcctagataccgaatcataataataacctggaatatctgacatttctctttcatttcctgtaataccaataataggctttgttaacattttgctccctcatcaaccaacaactgtctaataattatcattttacacctaaaaaaactttttgaataatattttttacctatcacttctttaacaatacctatcaactctcacaaaaataaaaaccatagtattaatactacggttttattttttagaaatctgctacattatgataaactttttgaacatcatcatctgattcgagtgcgtcaataagcttttcaaaagtttcaaggtcatcaccttccaatactacttctgattgaggaatcatttcaagttcagtaacttggaattcttctacaccattatcgcgaagtgcttggatacctttatgaagatctgttggggcggtataaactgttattgttccctcttctgcttcaacatcatctacgtctacatccgcttcaagtaattgttcgaagacagtgtcagcatcatcaccagcaaaaacgatgacaccttttttatcaaataagtaggataccgatcctgaagctcccatattgccaccgttcttaccgtaagcagtacgtacatttgctgccgtacggttaacatttgatgtcaaagtatccacaataatcattgaaccatttggaccaaaaccttcatagcgtccctctacgaaagtttcatctgtgtttcctttggctttatcaatcgctttatcaataacatgctttggaacttgtgcttgcttagcacggtccaaaacgaattttagagctgagtttgactcggggtctggttcaccttgctttgcagcaacatatatttcaacaccgaatttagcgtatacttttgagttagcaccatctttagcagtctttttggcaacaatattggcccacttacgtcccattggaaaatctcctttgatttcatttttaataacctgctggctcatattggcaagcaatcttaattttaactctattattatagcactttgatagcaattggtaaaatggaaattctatcaccaagctctagcatctgtcttatgttttaagtaatcaatccatctactatcctttacacgacacaaggtaactgataaaccagccatatctaaacttgtaattaggtggcctgttttaataaaaggtaattgtaaatcgtctaaagccagaaattccatgacagcatttgtaaaaagtaattcctccattttagaacttcctccaagattatttatcaatagaatgaatgcttctccatcttgccaacgtaatttcattttcaatttgttaactagttcgtttgccaaatgttccatggacacgaaaggcattgtccggtatcctggctcaccatgaataccgattccaaatgagatgtaaccttcttctatatcaaaaacaggttgatgctgacctaaaatagtggctgacttacttgctacacctaaagtagccattgaagttgtcaaagatagtcctagctgttctaattcatctaagcttgctccttctaaagcagcttgtccaataattttatgtagcaacacagtaccagcaacgcctcgatgacgaattttaaaatttgatgtttcaacagagatgtcatcatgagaaacgatgtatttgattggaatgccttcttgacgagcctgttcaatcgcttgggaaaattcttccaaatcagcttcaaaatttttgataataacaaagacacctttgcctcgattgataaatctaatagtctctagaatatcactagcacatggtggtacaaaaataggaccactaatcgctgccgatagcattccctcaccaacatatccaaagtgagccggctcatgtccgctgcctcctcctgataaaatcggaattacttgctcggattgccctaaataatgaatagcgggcaaatcttttatttgctctactttaggattagttttagtgattgcttttattgtttcaaaaacatattccattttatgatgttctgtttttctcatatccttgtcctaataattttctattgatgttctgataattttttcaatgactttcctattaaataattcttcttttgagttatttattaactcatattttataaaataagagagggctttactatgataattaataaatgtaactctttctttctgattaaagttagatttactataatcagaaagaagcttatctactaactgctcacagtaagactcaaaatacgaagaaaaatcattttgatcttcaatttgaaataatttaatatagaattcttgattcattttaaaaaaagtcaacaactctgataacaactgaaaacctgagatatagtctaaattatccgtaacttgttcgcttaattctgtttggaaaatccattctaataaagcatatttatcaacaaagtgattataaaatgtttgacgtctaatacctgcatcttccataatatcactcaccgatattttgtcaaaagcttgcgaaataaataaacgtttaaatgacttggctatttttttcttagtaataagcgaagaagtcataatttctcctttattttatattgaattgctgatgatttattatggtttagtgtaacatgatttatgattattgaaaaccctaacaaagcggacaaacaagaaaatctgtccattccagaaaaggcttacaaattttataataaaagagaattaaacataaaaggagtttccaaatgaaaaaaattctcaatcaaccaactgatgttgttactgaaatgctagatggattagcatatgttcataatgatttagtacatcgcatagaaggttttgatatcattgctcgcaatgaagagaagtcaggaaaagtggctctcatttctggcggaggaagtggacatgagccttcacatgctggtttcgtaggcgaaggaatgttatctgcagctgtgtgtggtgcagtatttacttctccaactcctgaccaagttcttgaagcaattaaagaagctgatgagggggctggagttttcatggttatcaaaaattattcaggggatatcatgaactttgaaatggcacaagatatggctgaaatggaaggcatagaagttgcaagtgtggtcgttgatgatgatattgcagtcgaagacagtctttacacacaaggaaaacgtggtgtagctggtacgatactcgtccataaaattctaggacatgctgctcgtcatggcaaatcacttcaggaaatcaaagctattgctgatgaattagtaccaaacattcacactgttggacttgcactaagcggggctactgttcctgaagtaggcaagccaggatttgttcttgcagaagatgaaattgaatttggtatcggtattcatggtgaaccaggttatcgtaaagaaaaaatgcaaccttcaaaggctttagcgacagaattagttgataagttaattgaatcgttcgatgctaaatctggcgaaaaatatggtgtccttattaacggtatgggtgcaaccccacttatggaacaatatgtctttgctaacgatgttgccaaactccttgaggataaaggcattgaagtgaattacaaaaaacttggtaactatatgacttcaattgatatggctggtttatcactaaccttgattaaactggaaaatcaagagtggttagaagcacttaatagtgacgttacaaccattgcttggtaatcattcctgttaattagaacaaaaggaaggaactcttatggaagtaaaaactgcaatagaatggatgcacacttttaaccaaaaaattcaatccaacaaggactatttatccgaactagatactccaataggtgatggcgaccatggtggcaatatggcgcgtggtatgactgctgttattgaaaaccttgataacaatgaatttagtagtgctgccgatgttttcaaaaccgtgtccatgcaacttttaagcaaagtaggcggagcatctggaccactctatggttctgcatttatgggaattacaaaagctgaacagagtaaaagtaccatttcagaggcacttggcgcaggacttgaaatgattcaaaaacgtggtaaagctgaacttaatgaaaaaacaatggttgatgtttggcacggtgttattgaagcgattgaaaaaaatgaattgactgaagaccgtatcgattccttagtagatgctacaaaagggatgaaagcaacaaaaggacgcgcttcttatgttggagaacgctcagtaggacacattgatccaggatcattttcttcaggattattatttaaagcattactagaagttggaggtgtctaatgtctgatattggtattattgttgtttctcactctaaaaatattgctcaaggagttgttgatcttatttcagaggtagcaaaggatgtctcaataacttacgtgggtggaacagaagatggtgagattggtacttcttttgatcaagttcaacagattgtagagcaaaatgataaaaagacgttattagctttctttgatttaggttcagcaaaaatgaatttagagttagtagctgatttttcagaaaaaaatattatcattaactctgtcccagtagtggagggagcttacaccgctgctgctcttctacaggcaggtgctgacctggatagtattcaatcacaattagctgaattaactatcaataaataaggagatattatgactcaatttcttggggaatttttaggaacatttattttggttcttcttggggatggcgtagttgcaggaaatgtgctcagtaaaaccaaagaagaaggaactggatggactgctattgtttttggctggggaattgcttgtaccgttgctgtttatgtttctggattattcagtcccgctcatctaaatccagcagtcacattagcaatggcttctattggagcaatttcttggggacaagttatcccctttatcattgcacagatgttaggagcaatggttgcggcaactattttatggttacactattatcctcattggaaagaaacaaaagatagtggacttatccttgccagcttctcaaccggacctgctatccgccatacaccatcgaatctccttggtgaaattatcggtactgctattcttgtgattacaattatggcaattggtcctagtaaagttgcagcaggtcttggtccaattatcgttggtatagttattttcgcagtaggattctctcttgatccaacaactggttatgctattaaccctgcacgtgacctagggcctcgtcttatgcatgctatcttacctattgaaaataagggtaactcagattggtcatacgcttggattccagttgtaggtccaattatcggcggtgtccttggggctatcttatacaatattgctttgactttagtttaactaaaaaaccagaaagttaatactttctggtttttcatagttgcagtatgctttcaaaatagaaaaaacaccaaaatacttagtgttctttctggagattttatgaaaaaagtttaggatgtttatagtataaccgcccttacttaacgtttccttaaaagctcggttattaacattacttcctaaattactatttatattctccaagaaatgactactattaagctaaaaagcgctattgacatagcgctttttagtctagtattatttagtttcagtagtaactccatcaaaatcttcttcattttcttcagcttcttctcttgtggcacggataataccatctttgtgatgagctggactgtaaattgtatagagttttaacatctcagtttcagaagtgttaattacgttatgttcagcacctgccggaactattatagcgtctccatctgcaacttcatattcattaccatcaatgacaaccttaccatgaccagcttcaaaacggaaaaactgatcattttctgcatgaatctcgctaccaatttctccaccaacaggcagtgtcattaaaacgagttgacaatgttctgcggtatagaggacttggcggaaatttgtatttcctagtgtcaatttttcgatattcccatgaaatcctttcataacgatacctacctttctatgcctacagtctactctttttgctccttactgtcaaaaatttagataagagtctgacatttttaataatatctactgttccttgattcctatcatttcattgcaaacctaaaatatagcctaatgacaatagctatctatagctttagaaacaaataatgctgttccctggcctccccaattatcaatagacttttggaaacgctcatcttggatgtacattattccaagacttgctaataaatcgttagtgcagttgtaaaactgagctgtgatataatcttgtaaaatctgaacttgtttttgaactttctcatctgtcggagaaagttctttcaactgtccaaagtctttaaaaatctgactcatagcttgtgaaatcattgaaaaatcattcttactatggctattttcaaattctttgtaactatctgtatccccccagcgtgttctagcttcctcttgaaatgcttctaattcttcttgattataagctgtaaaatctgacatatttttacccctctggatagactttgcatgttcaattacttcttctagtcgctgtttctttagttccagccacctaatttgatcaagaagtgcttgattacgatcataatttggactatccattatctcttttatttttttaagaggaaattccagttccttaaataacaaaatttcttgtaacttaatcagtgattcatcatcatagtaacgataaccattctctcctacaaatgaaggagataacaaatctatttcatcataataatgaagtgtgcgcacactaataccagaaatgtgacttatttctttaactgttttcataataacctctctgtaaagagtataatgtataacgttaagtaagggtcaagggaaaaatattattttgtgatgattaatttataaagcttaaatcaaaggtcactttgactaacaggttgataaaaagggatacgtccccatgtttgctctgctatattagcatttcccatctgataaacagaatctgctcgttgcgtcaaactatcccacgtttgtgaaccaatcctcgtcacgatatccacagacttcttcacagactttaaatgctgttgacctttttgtgtaaaacctaagacatgaatagcatttggtataggactttccacagcatttatcaagatataggttaataaacgtcgaattcttgctttggtataccgtttagttgcgactttatcaactaactcatccacagtctccacataacgaatttgactttttatacgattggctatctcttcattcacttgataaatttgtgtcaaatcagaatgcgtcattatctgatatttgagtaaactaaaataatcttgccaaactacttgtggactattcaaaaacaagtcactgttaggcatacctttttctacaaagaaacgatcagattgatgtttacgaagacttgttgcagaagcaaatatctctgttttttctgatgaatgataaccagctccttgacgttgtatcggatttaatcgaataccattttggctagctgctttggtgtaggctaagcctaaaatgtgatttggggtttgtcccgaaaatgtaatccctgcaaattcttgccacatagcttgcattttttgtggataggaaagagaatccgattgttttttcaaaaaagcttccatctcctcttttttattcacataaatatccccaatacgggcataatcaagcatttcttcggtaccgaagcataagttatccacacctaatcgtgccaggatagacacagctccactagcgaaataatccgctgactgtaccgaaaccagaaaagggagttcaatcactaaatcagcaccattttctagtgccatctgggaacgggtccatttatctacaatcgccggctcaccacgttgcataaaattacccgacatggctattacttttatgccttgagcttgttctaaaaggtacttatgcccattatgaaagggattaaattcggcaacaattcctgtaactgtcatacttctttctctttcaattgattatttaaagtaacagcatcaataatatctaggtgataagttttacgaaggtatatgagacgatctgtttctttttcaaatggttttaatgccgataataaatccaaatgaagtttagggttcatcaataattccaaaataactttagactttttctgacttacccgacgttcaataatataaagtatcccaaatatcatcagacaagcgtataagaatattatcatctttttacctccaaattattacttatttatgagctacaaaaaaccagcgagcagaagttgcagttggttttttatcttcaaaatctgcatacaccttaacatctttaaaacctgcctgttcaagtaaaatatcataagtcaaaatatcataagtacgctcttcatgaacttcatcatgacgtgtaaatcgaccatcttcttcttgaacaaaaaatgttaattcatggacaatagaatgaggtgcatcatcttcataagtatcccacaccatagcaaagtcatctgcattttcatgataagaataaccaggaaatactttatctgtttgataagtcgaatgaacatcaaaaataaagacgccattttcttctaaggccttatagacttcgataaaaacatcaccaacctcgacttcatcttgcatataacaaatagagtctgaatagcacgtgatgagatcatatttaccaacattagataaatctaacatatttccttcaataaactggatactttggtgagcagaagttgcacgttttttggcaagtttcagcatatcgccactaagatcaagtcctgtaacagcataaccagcttgtgcaaatcgaacagactgaattcccgtaccacatgctaattccaaaagttttttcttaccttttggaaaatgacgaagtgaaaaatcagtccatttagcatataaagtatcatccatgacagcatcataaacagctgcaaaagtttcatacgttgccatataatagttctcaaatctttcttgatattacatctctcaaaaagcagtcccaagactgcttagctttattctgtcataaagacttcagcatcaagcaatggtgcttcatgccaaagtttttcaaggttatagtgctgtctctcatcttcagagaagatatgaaccacgacgctattgaggtcaagaagtacccaaccagctttactatcgccttcaaggtggctagcatccccaccatttccttttacttgttcacggatattgtctgcgattgcttctaactgcctactattacttgcactcataatcacaaagtaatctgcaacactcgttacaggctgtaaatctaaaattacaatatcttctgctcgtttttcatccgcagccttaacgactagctgtagtaagtctttttctgtcattttattcctcgtttattaatttcaataagctatcttttgctaccattgtcgcaaaacgatgatgccaaatattctcgtaatgttttttaatagaatccccacttaaagttggtgtatcaaatgttaggtgtccaccttgtggaataaagatatcataaccatattcaaaagcaacttttactgatgtatcaaaacagtattctgtttgaagtcccatcatgattaattgactaatatgcttactttgcaagtaatcatgtaaatgagtatctttaaaacaactattgtaagttttatcaattattttgtgatgcgtcacaagatgtcgctgttcccaaatttcccactgtggagaaccttgaggcaattccttatcatgatgccttatccatatcacttcacaattagaacctttggcacttaaaagtaaatcatctaaaagcactgcaaaatttgttaaatgctttggtttcttatccataataccttgttggatatcaattagtaaaagtgcacaagtcatactttcctccaaaatgaccactgcatcgccaaacctatcatgaccattattcaataaaagaattagtcgagataaggtatataagcattataggtttcaatcgttttaggatagataggctgagccttacttgctaaaaacgcaactgttctagcagtctcataagctactgctttattaaggtcaactttcgctaactcacgagcttcttcaactcctggaaaatctcgattgtgttcaatgtaatctgctacataaacgattttatccaatgtggacatttgggctgaaccaacagtatgttttgcaatagcagctaaaatatcttgatctttgatagctagatcctcttgtattttataaatgccaacaagaccatgccaaatattattaccccatttttttaggtcgggatctggttggtatttatcaattaatctaagaaattcatcatcagatagttccttagcataatcatgtaataaagcagctagacccgctttttccttgtcataaccataccgttctgctaactctattgcagcacgctctactcctaacacatgattaaaacgtttgtcggacatcatatgacgcactttactcaaaagttcagtccgatctaaacctgtgtaatctttgtaggtcatttgtaaagaccttctttcctgatataatctaatacctctctaggcagtaaatagttgggctgacgattacttttaataaattgacgaatcatacttgatgagatatccatcaatggcagatccacccaaataacgggatatgatgtaccagctttatattttggacgttgaacaccaacaaactgcaccattttaacaagttcatcaatacgatgccacttaggtagatattccaccatatctgccccaataatgaaataataatcaacatctggatttttttcaattagaagcttcatcgtatcgtatgtatagctgatacctttacgttcaatttcaattggttcaatagataaaccatcaatgccttctattgctaattcaagcatcttgagacgatgctgttcatcaattgtctcttttttatcaatatgtggtggctgaaattcaggcatcaacagaacttggtctaaacacaattgctgacgtacttgatctgcaacaacaaggtgggcgttatgaacagggttaaaatttcctcccataattccaatttgttttcggttagtatctcgctttttctcttctaattcaacttttgtaaatggtgttagcaattcgagtgccataattcctccatgaacaagtagtatctctaaaaaaacaaacactgattatcatgatcagctatcatacggaagtgtaacttaggtaaatcgttttttagttctatactctatttcttaatctattgtagtttagtttgattttactgcttttactttaactgaaattttacgattttctttgcgcgctgactctttataaagaatcaagatacgtcctattttaaggacagtatcgcagccaatttcatcttccagaacttcagcgacatcgtggatatcttcatcggtattttgtaaaagggttactttgattagctcacgtgcatcgagtgcattacgtacgcttgttttgatttgatcatttaaaccatttttcccaatttgaataatgggtttcatagaatgtgcttctgattttaagaaagcacgttgtttagatgttaacatattagtttcctttttatctattataggattatgactgtatcatcagctaaattagatgaaaaaccgtcatatgttgctggttaatttagttattaaattaaagctttgcgtaaaacaactgccacgccttctggagcccaagcagctactactactggattttctgcttctgatttcacacgtatccaaccaagacccgaataaacaatatccattttatctttgattgtaaattcatgacgaactaatttaggaaaatctgaaacttccttacctgttggtggtgtcaataattttccaacatgtttagtgtaaaattcatctgctccaactagtttagtgcggtgtaaattcaggttattatcaaaatatgccgtaaaaccttgtttttgaccagaaataaaatcaaaacgtgctaggccagccaagaataatgtttgttctgaattaagctgataagttttgggttttatttcttttttaggactaacatatttaagattttttgctgtcaaataatgagccatttgatgacgatgaataatacccggggtatcaaaaatatagctaccatcatcaagaggtatttctattttatctaacgttgtacctgggaaacgtgaggtcgtaataacatcacgactaccagtaatttcacgaataatagcgttaataagagttgactttccaacattagtaaccccaacaacataaacatcttgaccatgacgatacttttcaatcgtatcaatcaaatccttaatagcatgatgattttgggcacttgtcaagatgacatcaacaggacgaagcccctcttcatgagctctctcagttaaccattgtgttacttttccatctttaaccgatttgggaagaatatcttttttatttcctactaaaagaacatcgtttcctgcaacgaaacgactaagaccaggaataattgaaccattgaaatcaaaaatatcaatgacattcaccacaagggcatcactatctccaacctcatgtagtaatttcaaaaattcatcatcagtgatatgaacgtcagtaatctcattatagtggcgcaatctgaaacaacgctgacagtataattctcctgtctctaaacctttttcaagtgctgcacgaggtgtatagccagcagcatctttattttcagtttgaatcctggctccgcagccaatacaaaataactcttccattaaattcctttttgatatacgattttaccgtaattctcttctatttttttccaaacgcgacgttcacgtaagcgattgaacttggtattccaagcatcagatttaacaattggttttaccaatacggactttattcctgcgcgatgactagcacgaatatctgtcatcaattgatctccaaccataatcacctcgtcacgatcaaagccataacgctcaattgccatgtttataccacgagtaaatggtttcatcgcacgacttacaaaatccacaccaaaacgtgatactgcacgttctacgcgagcatgattgttattagacactactacaactgaaatatccgctgttgtcatctcatctaaccatgcacgcacctcagcagtaccatctggattattccaagcaatgagtgtattatctaaatcaactaaaaccgcacgaatgccatgacgtaataaatcttctgctcttaaatcataaactgcctcaaccacgaaggtcggcctataatcatctatactcaatttcatctccaaaaaatatattttactattcattctaccataattcttaagagatagcgagtaaagaaaaaaggtctttaaagacctttaaattagggtttcaaccccaaaagatactatcttactcgtttcattttcttcaatgcaattaaatctttgtaagagattagagttacagcaagaaaaataaacagcatcccaagtaaatctattggataaaaaatttctcctaaaacaagtactgtcaaaaataccgaagaaactggctctaccgatgctaataagctacccttgacagcacctacaatactaacccctttaaggaaaaaagtgtaagcaaaaatagtcccaataccaataatgccaatataagcaagtatactcatcacattaatttgtaaggggtattgccacgcttttgtcaccaaactaaataaaatcccacctataaacattcctgaaccaataacaatcgtacttccccattcatgaataagtttcacaggtaataaaatataaatagaataagtaatggcggaaccaagcccccacattaatcctttcggtgtgatagctaaacttcctaacttcccatgcgttgcaatcatataggttcctaaaattgccatagcaattgctattatttcaaaagatgttggtctttgtctgtttaggatacaaacaatactcaaaataagtattggtgccatatattgcaaaaccgttgcagttccagcatttgttaaatgaatcgctctgagaaaagcatattgatttaaaactaaaccaaatatagaaaaaagtaaaacctgctttaaaaattttggctgtttccacgctgctactaaatgctccttttgttttgatctagctaaagacaagagaaagatacctgttatcaacaatcgtaaagaagtcaaaaggttaacgtgtactccgtgcgacatcaagtattgaccactaattccagaaatgccccatgctagtccggcagctaaggtcatcattgttcctttttcttttttagtcatttttcccctcatttttatttcttaaacactgtagttaaagtcatctgataaatatcttagcttcttaattatttatccctaggtgttcgtgctaaattagcgaataaaaaccagccaaaaggctgatttctattcttcttttaattttgctaattcttgcgctaacagcttcagagcaacttgtggattagcttgtccttttgttgctttcattagataacctgtgaaggccttatcagcattgcgttttcctgacttaaagtcaatcacagcagcttcattatctgcaaagacttgatgaataattgggattaatacttcaggatctgaaatttgaactaaaccagcctttttaacgaattcttcagctgaaccaccatttttagctaaatgcacaaaaacttttttagcaattttggatgaaattgtaccgtcagcaatcaagccaatcatctcaaccaaattctcaggagtcagaccaatttcttcgattgattttgattcactgttaagaaattgcgccacttctccttgtaaccaattggaaacttgttttgcatcacccccaatagcaacagctttttcaaagaaatcagaagttgcttttgtagctgttaattggctagcatcataagatgatagaccaaaagacgatacatatttcgcacgacgttcctgtggaaattctggtaattctaaacgaacttgatcaatccattcatccgagatatcaaatagtggtaaatctggttcagggaaatagcgataatctgatgagccttccttgacacgcatcaaaatagtctcacctgttgtttcatcaaaacgacgagtctcttgctgaatttgaccaccagatcgtaaaacttgtgcttgacgtttttcttcatgtatcaaacctttacgtacattattgaatgagttaaggttcttaagttctgctttagtaccaaactcttcttgaccataaggacgaagtgaaatattggcatctacacgcatagaaccttcttccattttaacgtcagaaattccagtatattggataatctctttgagagctgtcaaataagcataagcttcctcaggagaacgcatatcagcttctgatacaatttcaatcagtggaacaccttgtctattaaggtcaacataggaataaccatctgtcccatgtgtattttttcctgcatcttcttcgaggtgggcacgctcaatacgaattttttttcgtgtaccatcttctaattcgatttcaatccaaccattgtaaccaataggctcatcaaactgtgaaatttgataagctttaggattatctggatagaaataatttttacgatcaaaatgcatgttttgatggatatccatattcaaggcaagtgccgccttgattcctgcatcaataactcctttattcatgactggaaggacacctgggaaagaccagtcaattacatttgtattagcattttgttcctgaccaaaatgagcggaagaaggtgagaaaattttagagttcgtatttaattcaacatggacttcaagtccaatgactgtttcaaaattcattagttctcacctccaaaaattttaggttgttgtttatgataatctgtcgttgcttcgaaggcagcagcaacctgatatattgtttcttcactgaatttcggaccaatcaactgcataccaaccggtagaccttgatcaaaaccagcagggattgaaatacctggtaaaccagccaaattaactggtattgttagaatatcagctaggtacattgcaactggatcgtgatttaaagaatctaagtcaaaggctgttgttggagctgttggacctaaaatcaagtcataatctgcgaaaactttttcaaaatcttgaataatcaaactacgaacttgacctgcttttttataataagcatcgtaatacccagaagataaactgaacgttcccagcataatgcgacgcttaacttcgtctccaaaaccttcagatcgtgtattgacatagatatcatccaagtttttataattttctgtacggtatccataacgaataccatcaaaacgttgtaagtttgaagaagcttccgatgaagcaacaatataataaacagcaacaccgtatttagaatgcggtaaactaacttcctcaataactgcacctagtttttccagatgttttgcggccttaataatcgtttctttaactccttgcgctattccttctcccaaatattcttttggtaaagcaattttcattccttgaatatcttgaccaattttagcagtaaaatcgcctacagtacgctcagaagaagttgaatctcttacatcatgcccagaaataactgtcaaaagctgtgcattctcttttactgtttgagacatcggtccaatctggtcaagcgaactaccgaaagcaaacaaaccaaagcgtgatacacgtccgtaagttggcttcataccaacgattccattaaatgaagccggttggcgaattgaaccacctgtatcagagcccaatgataaacgtacttgtcctgaagctactgctgctgcagaaccacctgatgatcctcccggaactttactatggtcccaagcgttatttgtctttttaaaataagatgtttctgtagagcctcccatggcaaattcatccatgtttgctttaccaatcacaatcatatctttagcatataacttttcaacagccgtagcatcaaagattggctcatagttatagagcattttagaagcagctgttgtaagaatcccctttgttgaaatattatctttaactgctaagggaatacctgacataacattatcagcatcaattcctttatcatcaatttctttggcttgagctattgccatctcatcagaaatagtaataaaagatccaaccgcttgttcacgcgcatgaatatcttccaatgtagcttttgttaattcagttgctgaaatttcttttttaacgagaaaatcatgcaactgatcaattgattgattattaaacgacattaggcatctcctccatcctcaagaattgcaggtactttaatataataatcttgatgctgtggtacatttttaaataagtcatcacgattatggcctggttgagcaatatcttcacgcatcacggttttgcgatctgccatggtcgttgttactggtacgccttctgtgtcaacttcatttaagagttcaatcatatcaacaatctttgacaaacttgacgcaaattctttagtctcttgatcagaaaagcgcaattttgacagattggcaacatgacgcacttcttcttcagaaattttcatgagttctccttatctctgtatcattttcgttttaagatagtctctactattatagcatattaaactctcaatgttatcacattatcccagcttttcataataaacgcttcttacctatgataagaagcgtttactgtttatttatctattgttatatcatttctgctttgtttgattttagcctgtgcagccgctaatttagcaataggaatcctaaacggcgaacacgatacataatgtaaccccagttggtaacagaactcaatagatgatggttctccaccatgctctccacagatacctattttaaggtttggcttaacttcttttcctaacctcactgcctgcccaataaaccttcctattcctttttgatctaaaacttggaaagggtctttttttagaagtcctttatcaacgtattctcctaagaattttccagcatcatctcgtgaaaatccaaagctcatttgtgttaaatcattggtcccaaaactaaagaaatccgcaaactttgcaatatcatccgctatcatacaagctcttggtgtttcaatcattgtcccaatagggaatgataagttaatttttttagatttactctcctcaacaattgtctcttcaatcagatcacgtattatagagatttcttcatgcgctgtcactaaaggaatcataatttctggctttgcctcatatccctctttcattgcaagtatagcgccttgtacaagagctctcacctgcatttggtaaatttccggataggtaatcgcaagtctacaaccacgatgacctaacatagggttgaattcttctaatgtttgaatccgtttttcaatagctaaagtagatatccccatttgtcttgccatagattctatagactctttatcatggggtaagaattcatgtaaaggagggtcaagcaaacgaatcgtacaagctttacctttcaatactttaaaaatttgataaaaatcgtctctttggaaagataaaagcctttctagagccttccttcggctcaatatttcatccgctaaaatcatttctctaacgactggaatacgttcatcgtcaaaaaacatatgttccgtgcgacaaagacctattccttctgctccaaagtccaaggccttttgagcatctctcggattatctgcatttgaacacaccatcatatctcgattttcatctacccatttcataaatatctcaaaatcacgatctacgctagtctctgccatcggaacttgtcctatataaacatttcctgtagcaccatcgattgataacatctcaccttcttttatcgtttgatgcccaatagaaatttctcgtcttacttcatcaaccaataattgactacagcctgcaacgcatggtttccccattcctctggctactactgccgcatgggaagtcattccgcctcttgctgttataatcccgtttgcactaaccatcccctcgatatcttcaggtgatgtctcttgtctgaccaatagcactggatttccctttttcatctctttaacaacatcttctgcatggaaataaactttcccataagcagctccaggagaagctggaagtcctgtcgtcaaaataatagctttctttaaacttttcaagtcaaaagaagggtgtaataactgatctaattgtttgggctcgatacgtagtatagcttcttctttactaattaggccttcatttacttgatctactgctattttgatagctgccttcgctgtacgcttaccgcttctcgtctgaagcatataaagattaccattttcaattgtaaactccatatcttgcatatcgcgataatgagcttctaacttttgggtaacgcttacaaactcttggtaaataataggcatttgttctgccaattttgatatggattgtggtgttctgatacctgcaacaacatcttctccttgtgcattaatcaaatactcaccaaataaatttgctgctccagttgatgggtttcgtgtaaaagcaactcccgttccgctgttatttcccatattcccaaaaaccatagcttggatattaacggctgtcccaagcgtctccggaatatcatttaatttacgataaatcttagctcttggattattccatgatttaaaaactgcctcaattgctaacaaaagctgccttttaggatcttgcggaaatttttctcctgcttctttttgatatagttccttgtaaaattcaacaagtctctttaaatctgaaccagttagttctgtgtcatcttgataacatttatctgtcttaagtcgatctaaaatggtatcaaatttatattttggaatgcctgtaaccacatctgcaaacatttggataaaacgacgataactgtcataagcaaaacgctcgtcttctgtctttttcactaaaccttggacactacgatcatttaaccctaaatttaaaactgtgtccatcataccaggcattgaaaaaactgatcctgaccgaactgacaccaacaaaggatcatcaacacttcctaattgcttgttctgttcaacctccaattgtgccattgcttgatcaatttgactaagaatactctctcggatatggcaagcgttatcataataatcattacaagcctgtgttgtaatagtaaaaccttgtggtaccggtaacccaatactcgtcatttcagctagattagcccccttaccacctagcagttccttcatttccttacaaccttcatcaaaatgatacacaaacttagtttccatcagcgtctccttttacagatttttagctacttgtccatttgtttttaagatttctaaaataatcgttgctgtttcttcgattgctttatcagatacattaatgattgggcaacctaaatttttcataacttcttcagcatacctcgtctcctccaaaatccgttctaaactggcataatttgccgtactagaaagacctaaggactttaatcgaacttttcggacttgattaagatgatcaaccgaattagttagtccgataatccttctagaatcaatcatacgtaattctttaggaacaggaacctctggaaccaaaggaatattaataactttaatatttttatctgctaaaaacatacttaatggtgttttagaagttcttgaaattcctataataactaaatctgcttgtaaaatacctcgcggatctctcccatcatcatattttactgcaaattctattgattctactcttttgaaataatcattgtctaagcgtcgtaaaatccctggttctcccaaaggatctatacccgatatccttgatattccttgaataacatttgttaataagtcaacataagcataatgttcactttcacatcgtttctgtgcataggaagccaaagcaacatcaactaaactaaacatcataaatactgtcttctggctagcctcttcaaaaacttgttctaagcgttcctgactgttaatataggaaaaacgttgaaaatgccaatcatcatgtcctggaaattgtgacaaacatgctttcgcaatagctttggctgtttcccctaaagaatctgaaataataaatatagtgagttgatcttccatcagtttcctcctaataatctcttatttctaaaaacaaactagcgaggattgttttagataatttcccgatcactttaaatttttcgggatattgcttatcatgacgaacgacagggagactatccacttttctgctcactaatttatcagctgccgcaaaaagactttcattttctaaaacagttgtcacgtgtggcatacgtgtcatcaccattcctattggcattttagaaagatctcctccgccaatactgatttttagtaaatctttacgtgacacgactccacagagaaaatcatcatcatccaagataaaagcacaaccagcatcttccataaaaatatgtacaataacatcataaactgaatctttttgatgaactgtcagagggatccccataatttctgaaactgtcatcttttcaaaatgacttgtccctattgaagcatgatactgtcctaaataaaaataaccaaccttaggttttgcatctatgatacctagcatacttaaaaccgccaaatcagaccttagtgctgctcttgttactcctaatttctcagctattagctcaccagtaatgggctgaaactgtttgataatatcaataattctttcttgcctttgatttaattgaataagatcaccttctttatatattgtatactatttattttatatgttatattatatatctttttttactgaaatcaagtaaaaaaagatactattttaaaaataatcatactatatatttgcttttagacatatcttttgttaaactttcttcgaaaacgttttcgaatataagtatcggaggttgtaatatgacaattaaaaatctcactgttgcaggaagtggcgttctaggtagtcaaatcgcctttcaagcagcttacaaaggaatgtctgtcaccatatatgacattaacgatgaagctttaaataagggaaaagaacgcatcaaaaaattagctaaagtctatcaatcagaaattgaaacagcaaaagaagcatatagtgataaagctaaaagtatcaagtataataaaaacttattgcctagcttagaccatatttttctttcaaaagttgccgattcattagacttgattgctgatttaccaaaccaaattactttttcaaaaaacttagaccaagctgtaagtgacgccgatttagtaatcgaagctgtcccagaaacagttagtataaaagaagatttttataaacaattagctaaagtggcaccttcaaagacaatctttgcaacaaattcttcaacacttgttccaagtcagtttgctgatataacaggacggcctgacaaatttttagcaatgcatttcgctaacaatatttggcaaaataatattgttgaaattatgggacataagggaactgacgacgaggttatcaaagaagctttggcattctcaaaagatattggtatggtgcctttacatattcataaagaacaacctggctatattcttaattcaatactagttccattcttagagagtgcactagcattgtactatgataaggtttctgattctgaaactattgataaaacctggaagttaggaacaggagcaccgatgggacctttagaaattttagatattattggcatcgataccgcttataatatcatgaagaattattcagataccaacagcgatcctaatagtcttcatgctcaccttgcaaaaatgcttaaagaagaattcattgataaaggacgtaccggtaaagctgctggacacggcttttatgattacgactaaactataaaagaggttagataaaaatctaacctcttttataattcaactaaagaatagttgcaccaagaacagttttaaaatgatttaaagcccattgatgattactatcatttaagctagctacagctgctgctgggacctcaattttataacctaagttataagcatcaattgctgtgtgtaatacacaaatatctgtcaatactcctgtcaatatcaaagtatctactcgtctttcacgtaggcgaatatctaaatcagtgccagaaaaggcagaataatgacgcttatctatccaaaaaacacgactatcttccttaatagtttcatatagagttcccaaaggaccatataggtttctaccagaagtccctttaatattatgctcaggaaaaagattgctctctggatgaaaaacatctccaatatcatgattatcaatcgcaaaaaaaatataatcccctgaccggtatgctttctctgtaacgtcagctatagctgaagcgatagattgcgctggtttacctgccgttaatttcccatcatctgccacaaaatcatatgtgtagtctattgagatgagtgcttttgtcatttttcttcttatctcctcttgatttcaaaaaaggaactgaaagctactcccagtcccatgctatgattaattatattcttttaatttgtcaaaaataccttcgttaataactttgaggtatgttcccttcataccgagtgagcggctctcaatgattcccgcagactccaatttacgaagagcatttacaataacggaacgtgtaattccaatacggtctgcaataacagatgccgttaggcgtccttcaagtccatctaattctcctaagatagcagctacagctttcatttctgaataagatagagtgttgatagccattgtcaccgctgtttgtttacgaatattttcttctagattttctgtttgaaggttaagtaattgaataccaacaacggtgcttgcaatttcaactaaaatcaaatcatcgtcgctaaattctttatcattacgccagataataaatgttcccaagcgcattccaccaccataaattggagcgattgttgtaataccatcttggaagttttcctttgtctcaactgggaaaattgacaaatcattatctactgataagttagcttctgtatcataaacacgactagcagatttaacatagtaatctgggaattgttttgtttcaaaaaattcttccacacggtcagtgtttgttttatatttcatggcatagccaagtaagttaccaccaccattaataatacatgcgttacagtcaataatatcagctaattgagccgccattgtattatatggtagttcggcatctaagctatctacggaacgctgtaagatggatgtaatttttctagttttttctaataaattcggcatttccttcatcctttgtatgttttgcgttacaattatatcaaagcattttagcttttgcaaatcgatatcagtacattttaagaacttctattgttaatttaatgtttatctaataaaaattcattctagcgcttgtattggcttaaaaagcgagccattttttcttgtagttcagtcaattcatcaacacgtggtaagtaaacaattctaaaatggtcagcggtattcatattaaatcctctaccgtgtgttagtaatactttttcttgttttaagaaattaagcacaaactcttcatcattatcaatacggtacatatctgtatcaattttagggaaaagatacagtccagcatttggttttacagcagataaaccaggtatttcattaattgctttatggatataattacgttgctcgtagatacgacctcctggcaacaacatactatcaatagattgctgtccgcctaacgatgtttgaataacctgttgagcaagaacatttgaacacagcctcatgttagctaacatattcaaaccttcaatataacctttaacatgttgtcgcggaccagacaataccatccaaccaacgcggaaaccacagatgcgatgtgatttagataagccagataaagtaactgtaaaaatatcctctgcaatagaagcaattgggatatgctccattccatccataactaaacggtcataaacctcgtctgaaaaaataatcaagtcattttgtctagcgatatccacaatctcttgcagaatttcacgcggatagactgctccagttggattatttggattaatgaggacaattgcttttgttttggatgtgatttttgatttgatatcatcaatatcaggataccaattagcttcctcatcacaaatataatgcacagcatttccaccagcaaggctaacacaagctgtccataacgggtaatctggcattggaactagaacctcgtcatcattatcaagcaaagcttgcattgacatagagattccctcactaacaccattaacaatgtatatatcatccatgtcaacatggatgttttgtaactggtaatactgcataacagccttacgagctgaaaaaatacctttcgaatcagagtaaccttctgattcacgcgcattcgtaattaaatcacgaatgacttcatctggcgcttcgaagccaaaggcagctggatttccagtatttaaccgcaatatcttttcaccatttgccctcatgcggtccgcctcttctaaaacagggcctctaatatcataagctacatgttccagcttcattgatttatcaaatatcttcataaaaatacctcgtatcttccattataaaacaaatattctcaaaattgaaacttttactgcggtttatcaagcgattaagttaatattaagctatttcagaaaactaacataaaacgctttcatttttctagaaaaaacgttataatatagctataaaatgaataaccaacatatctaacttactcatcactcactccttctgataagatggctagttgagtgcaagaggttatctcttttggttatatttagaggaggacaggcttatgtcacaaaaatatgaacgcatccttgtcgctattgatggatcaacagaatctgaacttgcttttgaaaaggcagttaacgttgctcttcgcaatgattctgaattaatcttgacacatgttatagatacacgtgctttacaaagctttgcgacatttgatacttatatctatgaaaaattagaaaaagaagcaaaagatgtccttgaggaatatgaaaaacaagctcgtgaaaaaggagcagataaagttagacaagtcattgaatttggtaatcccaaaacattacttgcacatgatattccagaaaaagaaaaagtagacttgattatggttggtgcaacaggtcttaatacctttgaacgtttcctatcggatcttcctcagaatacatccttcgtcacgctaaagtagatttactcattgtacgtgaccctaataaaacaatgtaaatttaaatacgctcactttctaaaatatcctgagttatattaactcaggatatttttattttcgatttaaggatttctgaatttggctatctaattcacgtcgaattgatggctcaggagcgaaatgttcttcccagtcgtctggttttaaaattttatgagtaacaggatcaaaatgagctttgccatctggaaagattttccccatattggcctcatgtactgtatcaaaaagaggttttgggtcgactcccataagaacaaaggagccataagtcagataaagtaaatctgttaaggcatccacttctcccactaatggtgtttctggatggtctttagaaataaccttatctcttgctttatcaatagctaagtgtaaattacggatagattggtcaaatactttttggttaccttgactagcagcatacaagaactcaacgatttcttctactttaaagtctgacctgaaaccagcttccttactgtcatataagcgtggcgtttcaatagtttcaccatccattaatagatggaaggattttactttattgaaattctcgtcacgactactgaatgttttttcaatctcaaattggataagtccataatgggctaatgccttagagataccatcatcattattgtcagcagttgtataacgtgcattttctctcacttgctgactagcgttccccatggcaacaccaatgccaacttgagataacatctcaatatcattatcagaatctccaaatgctatcacttcggatagatcaaaaccatagcgttgaccaacacgttcaattcccttaacttttgactgcccttcagaaatgacatccattgagtaaggactgcttcttgttaatttaacacgaggaaattgtttttgaattcgctctgattcgccctctgttgcaactaaaacgacctgataaataggttctcgtaagataaccatgaggctatcaatattttgaggtttaatccgacgaataaaatgcttaaagcttcgttcaatcgcttttgcccattttctcggaacaaggctagatacaatctgccccaaacggctagttcctagaccaataatacctgaaccgagtaatcctgaggctgttcctaatgaaatttctcttcttcttgctccagcataacgaatcagacgatagacagttgtcttagataattgattggtataaataatttcacttctactatagatatattgaccattataggttacagcaaaatctaaaccaaggttttctaaaaaaggttgtacaaaactaggacctcgccccgttgctaaaccgactagtattccttggtctttcaaatttcgaattgctttaattgttgacttttgtacattcttacgatcattaagaagtgtaccatcaatatcaaaaaatactgccttaattgccactgggtcaacatcccctcttttttatgataaaataaattatatcacaacttgaaagaagtataaaatcaatgaaaaaaatccttgttctacacacaggtggaacgatttccatgaatgctaacgagaagggacaggtcatgtccagcgccgataacccaatgaaatacgttgatttatcattagatgaccttgatttgactgttgtagattttctaaatcttcccagtcctcaaatcacccctcatcatatgcttgatatctatcactatctgaagcaacatgccagtaattttgatggtgttgtcattacgcatgggactgacactttagaagaaacagcatattttttagacacaatgatactccctaaaatcccaatcatcattaccggtgctatgagaagcacaaatgaacttggtagcgatggcgtttataattacctatcagccctccgtgtcgctaatagtactaaagctgccgacaagggggtgctagttgtcatgaatgatgagatacatgctgctaaatatgtcacaaaaacacatacaacaaacgtttcgacattccaaacccctacacatggcccccttgggattattatgaaacaagacctgcttttctttaaagcaactgaagagagagttcgttttgatttagataaaattacaggaactgttcctatcgtgaaagcatatgctggcatgggtgatagtggtatcattagctttttaaattctcaaaatattagcggattagttattgaagcactcggtgcagggaatatgcccccaaaagctgcacaagaaatcgaagaattaattgagcaaggtgtccctgttgttctagtgtctcgctgttttaatggtattgctgagccagtttacggatatgaaggtggcggagcaaaattacaagaatctggtgtcatgtttgttaaagaactaaacgctcccaaagccagactcaaattactcattgcactcaatgcaggtctcacagggcaaaatctaaaagactatattgaaggttgataaaaaactctagaaatatttctagagttttttattaattttcagtttgtaatactctctcaacactgctaataggcatttcttgattcgttattaattgaaatgcttctgctccttgataaatcagcatccctagaccattataagcatgtttcactccattttgtctaacaaatcgtaacaatgctgtttctttaggcttgtaaaccaagtcgacaactactaaattcggtgttaaaatttctggatcgttaattaaactataattatctaatggcctcattcctaaactagtagcatcaatataaaaatgactagttctaatagcgtctttaaatgctgtcttattttctagataatcaacgactacctttatttgaaactgttttttaattttatctgataagtcaatgaccttatcgtaatttgagctgttacgattaaataatctaatttccgcaactccctccatagctgcttgaactgcaactgctttacctgaaccaccaataccagctattgtaattattttatttttagcactgaaaccttgagctgctaaagctttaaaacaaccaatgccatctgtcatatggcctactaaacgtccggttccaccttgattaacgatagtatttacagcacccactaatttagcttgaggagataaatcatctagcaaagggataacactctgtttaaatggcattgaaacattaacaccacgaatacccaatgccctgacacctcgaacagcttctgttaatttaccctcttctacttcaaatgtcagataggcataattcatgtttttttcttgaaaagaggtattccacattaacggggatagagagtggcgtgcaggattggcaattagaccagttagtaaagtttccccatttaatgaattcattgtataaccttctttcttaacaatttatttcagttcattttaccaaaaactgactcaattaaaaagagagtatgtaatttatactctctcccttagtttaaggcaatatattacctgcactacggtaaatatcataccattctttacgggttaaagcgatatcattagccttatcaatcgcctttaaacgagatggattcattgaaccaacaatcgcctgcattttggcaggatgacgtaaaatccatgcaatcacaatagcttcgctgctaacattgtagttttttgccagtttagctatggtttcatttaattccttataatccggatgattaacaaataaaccacgagataaatcaatttgaaatggagaccaagcttgaatggtaactcttttaagacgacaataatcaacaatgccatcatcatgttcaattgaagctttatttaacatgttaacatttaaccctgcatcaaacattggtgtatgtgctggcgataactgaagttgattcactgctaagggctcgtcaaggtaggattgtaacaactccatttgaaaccggttttgattgctaacaccaaagtgttttactttaccttctgccctcagtttggtaaatgcttctgctacttcttcaggctcaactaatacatctggacgatgaagaatgagaaaatctaaatattctgtccctaatctttctaaaataccatctactgatgataaaatatactctttagaaaaatcaaagtaaccttctcgtatcccacatttagattgaataatcattttgtcacgattgacatttaaatgtttgattgcatctcgaaagcgtaattcagatagccctcccccataaatatcagcatgatcaaaaaaattaatacccaaatctaatgctgttccaactacttcttcagcttgttttcctttcaagtcactcattctcatacaacctaaagcaattcgagttgcttgaatgcctgtttgtccaatgttttgtaacatatgcaccccattctaatctgtttgtattaacagaaagattaatcaattcattataacaaaatttctatgaaaaggcttactattacaaatgcaaaaagctgagtaaatttaactcaactttttttctgatactcattattgactaaataagtcggtaagaaaaatctattctgaaaagtactattataaattacagtaatcattattgtcataacatacctccacatctgtgataggaatatcatatgacagcaagcttaaactgagcttagcacagccttaatagaaacttaatcaaaatctgaatgttggcgtaaattatctagaataagtgcccattctgtattttctttccaattattatctttgacaatatcactagcaacacgtctggcttcttctaaaataggataatcctcaacgatatcagctacttgaaattctggaattccagactgacgagtaccaaagatttcaccagaaccacgcatttttaaatccgactcagctaaaacgaaaccatctgtcgtttctgtcatgattgtcattcgttttttcccagaatcagttttgggattagccactaaaacagcgtatgattgtttatatccacgaccaacacgcccacgaagttgatgtagctggcttaatccaaaacgatcggcatccataataatcatgatcgttgcatttgggacatttacccctacttcaataactgttgtagatactaaaatatgactttttttatccttgaaatcttgcattatagcatctttttcatcatttttcatacgtccatgtacaagagcaaccttagcaattccttcaaaataagtagataattcagcatgcaatgctactgcattctttaaatctaaagcttctgactcttcaatcaacggtgaaatgacatacacttgagcatctttttgcaattcaccttttacccattccaacacagtacctagctgctcgtgtttcacccagcgtgtaataataggtttacgaccggcaggtaattcatcaataatagaaacatccatttctccaaaagctgtgattgctagagttcggggaattggggtggctgtcatcattaaaacatcaggattttctcccttttcacggaaaattctacgctgtttaacaccaaaacgatgttgctcgtctgtaattacaagccccagtttatggtactgtaccgagtcctggataagagcatgagttcctacaatcatatcaaccgagccatttgcaatagctgctaaaaccgtacgcttaacagctgctttcatacccgaagttaatatagcgattgataaatctggaaataactcttgcagactaatgtagtgttgttcagctaggatttccgttggaaccatcaaagccgattgaaaacctgctgtataagctgcatacattgatagaccagcaatgactgtctttcctgatcctacatctccttgcaataaacgattcatatgagctcccgatgacatatcagataatatttcatctaaagagcgcttttgagcattcgttagaataaaaggtaaagaggaaatttttgtctccatagcatgtttactataaagaataggcaaaccatttgtttcagatttattttcggatttcaaaacttgaaggttcatttgaaagtaaaataattcttcaaatttaatccgacggagcgcttgcttatactctgtgatatcttttgggaaatgcatagctaaacaagcctgactacgacccatcaatcggtatttttccaataaagtagctggtaaattttccttcaattccaaatgcgcactgatttcaaaagctgacttaatagctttaatcaaagtagactgtgaaattccctgagctacgcgataaacaggttgcatgtcatcttcaacttgagctaaaaccttcatcccagtaatagctgatttagttgcatcccatttaccaaagacagctacctcttgaccaagttctattttatcagctaaatagggttgattaaaaaaactaacatttaagacagcttccccttgacgcaacttaaaacttaaacggttacgtttaaaaccataatattgtacattagctggagtaacgactaggcctgtaatgactgctttttcaccatccactaaatcaaaaacagattttgatttaaaatcttcatagcgaaacggataataaagaagtaaatcttctactgtataaatatctaatttctgaaatttttctgctgattttggtccaaatcccttaagattagaaattggtgattgtaatagcataagattctccttctaatatcttttattatactaaaagatcaccaaaaaggcgcctcaagagcgcctttattatgtctaattatttatggccaataacataagttaattgtgcagcttgtgctgaactaaaagtacggtaagagacaataccacgtcccattgcattagattctgaaataagaactgaaccatcttttttaacttcttcaacaatagctacgtgaccgtaagtgccatcagcaccagcttgtcctggtgaaaatgatacagcatagcctacttttggtgaatgtgttgtttcaaaaccagccttatgttgccaatctccaccattacccataaatggatcaaatgtataacctaactctttagcgcggttaaagacataccatgtacattcaccccatggataagttgatgcaatatagctagctgtgttaactgctgttgataagctaaaaccacttggtaaatctgctaaacttgctgtcgataaagctttcaaggcagcaggaatttctggtgtccctccatgttgatcaatccagcggtctaaatcttccataatctgggcacgacgtttaccagttccagagttatctgtataataaacaccaccctcagtaactgtattaagttgtccagaagataatttctgtgctttcaaatcttggatttcaaagctagagttgttgtttttaataattgtattttttgtcaacaacataattgcttcttcatcattataagcactagcatggctagagtcatgatcaaaggcaccataaccaaacatattagcacctggcatcttagccactccttgagttcccaatgaactttcaaggacagcaatagctacaatagcacggacatctaaaccactatctttttcccattgtaataacttagcaccattgatacgattagaatcatattgaatccctaaagattttaagtacccatctaattgttcagctttgataccgtaacgatgtgacaataaatagtgagagtaggcatcctgaccagaccagtgttctacgtagaatggcgttgctgtcactggtgaaatcggtgttgataataagttatcatcaaaggataaagcaggaacagaagcattctgatttgtctgaacactttctatctgagacggagcgggagttattttaggctctactaatggtaaggtaggctcaggttttaattcagtctttgttgattgacctggcttactgtctgcttgactactgtttgtagtattagtgctaggagtagatgctgttgaagcagaatcagatgttttagcatcttcgttggaagaagattgatgtgatgaacttgatgatgattcattgcttgatgatgtctctgtcgtaccaatctctgttttttctgttgagatacttccttcggctgaaggtgaagcagtttctgaatctgtaggttgtgttttttcctgtttctctgcttcagaagaactttctgttgatgctgttgccattgtcaggcttgtttctggattaatagtttctgctaaggtcactaaaggtgatgatagcgataagactaaagtggataacaacaaagttgccattactttttgttttgacatatactaatgatttccttctataaaaattgtcactgattagtttaacatatttttaaattttttaaaacagttaactactgtgtcatttgtttttaataatatctcggaatacgatcgcttaaaagacaaagtacttcataattaatcgtctgtcttttttgagcgacgtccgtagttgtaatgttacaactaccttgttgaccaatcaaggttactttagttccgatagtatatttttgaggtaaacggatagtcatttgatccatcgagacacgcccaataatttcacaaagttctccatttactataactgaaaatccttgcatatctcgtgtccatccatcagcgtagccaatcggtactgttccaacaaattcgtctccagtaacttgataggttgcgccatagccaacttgagaaccatcgtgtagttgtttaacatgtactagctcagactctaaacttaaagcagggtttatagggtaaggtaagtctaaatcagttccacttggatttaagccgtacataacaacacccaatctaacggcattaaaaattgtctcactatgccaaaggcttgtagcagaattactagcatgaacaaggtccggacaattatctaatcctgaaataaagtctttaaaaaaagtaagttgttgattgaatttacagttatcggcttcatcagctgttgcaaaatgggtgaaaatccccttgacagaggcaccactttcccccaattcagaaattagcttatttccttcatctaactggcgaacacctatacgtcccattccactatcaactttgatatgtacttctagaccagataaatctactgctgatgtctgacataaacgtaaccactccaagctagcaactgttagagtaatattttcatttttggctagtataacctgctcaggcataacaacacctaataccaatatcatttttacaattcctgcttgacgtagctcaatagcctcatctaaattggatacgcaaaaaccatctacaatagactcaatgtattttgaaacttcaacagcaccatgcccataagcattagccttaactacagcaaatgtttttttatcacttggaatgtgctcttgtacagatttaacgttatttgcaatcgcctctaaatctatcaaggctctggttggtctatgataacttgaaatcatttttcttcctccaaaataacactagcttgtgcataattaccactatgagatattgaaacaaaagattttccattaaacggttcttttgtaatcaaaggcgctcctttatcatccgataaaatttcgatatcatgaaaattaactttcccaattcctgttccaagtgctttgctataagcctcttttgctgcccatcgccctgttaaaaaagacatctgacgcttgggattggaaattcctttaaaaagaagcaattcttgttcggtcaaaacgcgttctgcaaaacgttgattacgctcatatgctttagtaatcgcctctatctcttgtaaatcaattccgtgtccaacaatcatgtgtaactcctataagttcgatacttacaaactattgtaaatatccctaattagcatttctgttttatcccaacctagacatggatctgtgatagacttaccaaaaacatctggtttatcttgtcttccatcttctaaataagattctatcaaaaaaccacgaacatagtttctaattttagtatgccactgtcggtctgcaagtactgatttcacaatgcgaatttgttctaaaaattgcttacctgaattgtcatgatttgtatcaacaacaataaagggattttgcaaatcagtctcttcataatgagtaatagtttctaaaaggttttcataatgataattagggatacttcgatagtcggcattatgatatcctctcaaaataacatgtgacagcaaattaccatctgttctaacttgcttattttgatagaataattcctgttgattttgtgctgcatagaccgcattaaacatgactcttaaattaccagacgttggatttttcatacctactggtgcatctatacctgaagatataaaacggtgtccctgatcttccactgaacgcgcaccaatagcatagtaagaaactaaatcatccatcactgataacatctctggataaagtaattcatcagctgtcaggagtccagtctctcgaatgatgtcatagtgcatcttacgtgcttgaaaaaaaactcctagtttgtcagaatggtgaactaagcctttataaccatcaccattcgttcttggcttagcggtataaactctcataaccaaaaacattttatctttaaaggcagcttccaatttagctaaacgctttgcataagttagcaccgcctttggattatccgcagaacaaggacctactattactagaaaccgctgatcctcaccttttatgatattttttaactcttcttctttggctaattttttttggctaacttctagatctaagctagttttctgcttcaatatttcaatattaattttatcacttaactgatgaaatcccatgttttttcctaatacaacctaagtctattaataagctctgctatacaatatagtcgtcatactattagacaagtaatgataaaacagtcttctcagactgttttatttttattttaaaatcattgttattgtaaacatctcagaccatgacaatttttaaacttcatgccagagccacaaggacatttatcattacgtttaatcccttggtattctggtgattcattattcataggtacatgttgtgccgagatattttgctctgctgttgtcgtagcatgttgagaagcacgttcacgctcttgttcatgaatttgagctttcatcaatgtacgtgtcacatcaaactcaatcgaaccaatcatatcttggaacatacggaaaccttctgattgatactcaacgattgggttattttgagcataaccacgaagtccaacggagttacgtaattgatctaaggcatcaatatgctctgtccattgattatccactaccatcaagattaagactttttggaattcgataatagcttctggatcttttaatttagcaatttgttgctcataaacagctaaggcacgttcataaagaagttctttaatttcagcctcttttagaccacgaagttctgaaactgtgatagcttcttcatctaataacgccgatcttgcaaaattaacaatagcttctgctgcagtatttttatcgcttctgctatgtgcatcaactgctcttttaatcgtacgtttaatcatccctttgagctctggtcctaaatcacgctcagcagtaatcacttctctacggttagcataaataatctcacgttgttcacgcataacatcatcgtattgcaagacttgtttacgtgtgtcatagttattaccttcaacgcggcgttgagctgattcaacttgtcgtgtcaacatttttgatttaataactgtatcatcttcagctaaattcattcgctcaagaaccactttaatacgatctgtaccaaagcgacgcatcaaatcatcttctaacgaaagatagaattgtgattcacctggatctccttgacgacccgaacgaccacgaagctggttatcaatacgacggctttcatgacgctctgtaccaataacacataaaccaccaagttcacgaaccccttcaccaagcttgatatcagtaccacgaccagccatgttggttgcgattgtaacagcaccacgttgcccagcattcataatgatttgagcttctttaaagtgatttttagcattcaaaacttcatgtggtactccagcagcaactaattttctagaaattaagtctgacgtttcaacagctactgtaccaaccagtacaggttgtccttgttcataacgttctttgacatctgctaccaccgctctaaatttagagtcaagagttggataaagtagatctgaatgatctatacgttgaacaggacgatttgttgggataggaataacgcgcatattataaatttcacgaaactcttcttcctcagtcttaccagtaccagtcattcctgctaatttatggtacatacggaacatattttggtaagtaattgaagcgctcgtttttgattcttcttggattggcactgactcttttgcttcaatagcttggtgtaagccatctgagaaacgacgtccttccatcgtacgaccggtaaattggtccacaattaaaatctcttgttcttcactaaccacataatcaatatttaacaacataatatagttagctcgaagagcgttatcaatgtagtgagttaaggcaacattttcgagatcatacaagttatttagatggaaatagttttcagccttgtcaatacctgtatctgataaaccaattgtttttgttggaacatcaatgatataatcatcgctattaagcgtttttacaaacatgtccgcacgtgtatacagttggttcatctcagagcttacaggacctgaaacaatcaatggcgtcctagcttcatcgattaatacagagtcaacctcatcaaccaaagcatagttgagtgggcgttgcaccatatcttcttggcgaacaaccatattgtctcgaaggtagtcaaatccgacttctgcgttagttgagtatgtgatatcacaattgtaagcttcgcgtttttcaaatggtgacttagctgctaagttaatccctacagataatccaagccaactataaacctcacccatttcggtcgcatcacgtgttgataaatactcattaacagtaataacatgaacacctaatcctgagatagcatttagataaacaggcattgtcgctgttaaagtttttccctcaccagtacgcatttctggaatatcaccatggtgaagaacgataccacccataatttggacgtggtatgggtataaacctaatacacgtttagaagcttcacgaactaccgcaaacgcttccggtaacaattgatctaaagtttcaccattttgataacgttctttaaattctggagtttttgcttgtaaagcttcatctgataacgcagccatatgatctgcgtaagagtcaactttcttagctattttatctaatttttttaattcacccttgtcattttcaataacagtgcgtagaatatttgccattctaattcctttcgatactcttatcaccacattttaccataaataatgttgtctttcaataaatggtcgttttaatcgagattaaaaagagtggtatccccactctcattattttttaacatgacttgctataatttctaactgtccatcaatatcccatttgacaacatcatttggcaagataaagtggtcaccttttttaagtgtataaactttgttatctactgtaatgtgacccgctccgtctaagacactaaccaaaaggtagggtgcaaattgtttaaagttggtaacaccagaaatttcccatttataaactgtaaagaaatcatttgaaactaataaagttgaagatagatgttttaacttcatattggcaggaacagtattggcaggtttaccaatcgtgagaacatctattgattgttcaatgtgtaaatcacgtaattttcctgaagcatctggacgatcaaaatcataaacacgataagtagtatcactagattgctgtgtttctaaaattaatatccctttacctatagcatgcattgtcccacttggaacgtagtaaaaatcccctgatttaacaggaattcgggttaaaagatgttcccaatctccagattcaatcatttggcgaagttcttctttagttttagcattatgaccatagataatttcagatccttcatcagcagaaataatataccaacattctgttttaccaagttcaccttcatgtttaagagcataagcatcatccggatgaacctgtacactaagccagtcattagcatctaagattttagttagtaaaggaaagacagtatcatcagggttgccaaataagcttttttcaccttgatacagcttatctaaaaaacaacctttaaagcgaccattcttaactcttgagacaccgttaggatgagctgaaatagcccaatattctcctgttgtttcacttggaatatcatagccaaattcatcccttaactttgttccaccccagattttatcgtgcatgcttgcttctaaaaataatggttccgacataagaatcccctatcttttgtaaaattcaagcctattatagcattttatccatcatatcgcttactttttttaatcttttatttgctaactaaactaagtagtggcttaagggttttattaaccttttgatattttctttgctaaagcaaaatttcctaacgttgcagaaccattttcttctatagctggtgtcacaatataatcagacaaatcgggaactggtaaatacccatttaataaagttgcaaatgtctggcgaacacgtcttaacatgtgctcttgtgccatgacgcctccaccaaatacaatgacttgtggacgatataatacagttgcttgtattgcagcctgagcaatataataggcttgaacatcccaaaccattgaattttcttcaatcaattcaccacgaataccagtcctagcttctagagttggaccagatgccaaaccttctaaacagctattatgaaacggacagatacctttaaaatcatttgcttggtcctgcggatgcatcgccatataagtatgacctgcttcagtatgaccagttcctcctataaattcacccttttgtatagctcctgcaccaattcccgtaccaatggtgtaataaacaagtgaatcaatattgttacgagctataacttcaccataggcagagctattaacatctgttgtgaaataaaatggaacattgaaatctttagaaattaagccgagtaaatcaacattagcccaatgcaactttggggtcgttgtgatataaccgtatgtctttgattttttatcaatatcaatgggaccaaaagaaccaatagcaactgcctctaacttcttttcaaatcttttaaagaaatcaacagtctttttaatcgtttcttgaggcgtcgttgttggaaattgcattttttctacaacttttaattcctcatcaccaactgcacaaacaaactttgtcccacctgcttcaatactaccatataactttgtcatcttttttcctatctataatctctatctcaaagacaaaggttgggataattatcccaacctttaatcctcacttaacatcaataatcatgtcacctgtagtaacaacaccctcttttaccaatggtacaacatcagcaaaatcagctgtattagtcacaataatcatagctgtattatccagacctgcttctgcaatcttggctgaatcaaaggtgccaagaatatcaccttttttcactttttggtctgccttgactttagaagtaaaccctgtgccattcatggtgacagtatcaatacctatatgaatcaaaatttctgcacctttatctgatttgataccgtaagcatgacctgtttcaaaagcaatttggacaaaaccatcaacaggtgagtaaattgtattacctcttggtttaatagcaaggccatctcccataatacctgatgaaaaaactgggtcacttactgtatcaagagcaataacctgtccatcaagagggctaacaatcgtttctgcccttaattggctagtttgagtaattgttggatcgtcatctgtttcttcaaccaaaggactaacttcagctactgctttttcatctttatcttcatatccaaacatataagttaatacaaaagccaaagacgtagttccaattaccataataaggtacttaacaatttgaccatttaaataaagtaatgttcctgggataatggtaataccaaaaccagttcctgctaatttcaatattgaagctaaccagccacctgctgctcctgcaattaatcccataataaatggcttaccaaaacgtaagtttactccaaatatagccggttctgtaataccaagtccagctgaaagcgctgccggaaaagcaagggcttttaattttttattttttgttttaacaccaactgccaaagtggcacctgcttgtgctgtcatagcagctgtaataatagcattaaatggatctttcccatcagcagcaattaactgagcttcaagtaaattaaagatatgatgaacacctgtaacaacgattatctgatgaacaccacctaaaataagacctgacaggccaagaggtaaattaaggacaaattttgtccctgctaaaacatagttttcaactgaatggaaaataggaccaatgacaaaaagtgctaaaattgacataactgtaaaagttaggaacggcactaatagtaaatcaagaacatctgggattttcttatgcaaccatttttcaagtttagcaccaagtaaacctacaaagaatgccggcaatactgaattttgataaccaactactggaataaaaccgaaaaattttatgggatgggcatcacctgaggccactgcccaagcgtttggaagggcagagttgaccatcatcaatcctaatacgagaccgataacaggatttccaccaaaaactctaaaagctgaccaagaaatcaaggcaggaaaaaaagcaaaggccgtgtcagtcaaaacgacagtataggtataaaaattagaacttgaaaatgcttttgaagtcgtcccaaataaagctaaaactgtatcattattaatcgcaccgcgaatccccataaataaaccagtagcaacaatggctggcaacaatggaacaaaaacatcaccgaaagtacgaatagctcgttggaaagcattcccttgtttagctgcttctgccttttgatcagaggttgacgaagttggcaaaccttgagccactacttcatcataaatcttattaacagtaccagttccaaaaataatttgatattgacctgaattgaaaaatgctccctgaactttttcgatattttcaacagtatttttatcaatgactgtctcatcttttaccataacgcgaagacgagtggcacagtgtgctacgctacgcacattactagcaccaccaatcgcattaatgacttgtttagcaatttctgtatttgaagccatctataaatctcctttgatattttgaaagcgtttcattttatttactctaatattctagcacgtctcataaatatatgtcaagcgtttgacataaaataatatttttcgatataaagtgttgatttcaaaagagaaaacgtttactatatagttattagatattaagacagtcaaggagtatcaaatgaatttacccactgaaatccgctatcgtccttatgatgaatggactgaagaagataaggaaaatattgtaaagaatgtctcaaaatccccttggagagcaacttatcacttagaagctaaaacagggcttttaaatgacccaaatggcttctcttactttaatggaaaattccatcttttttaccaaaattggccctttggagctgcacatggtttaaaacaatgggtacatacagaatcagatgatttagttcatttcaaagaaacaggaatcaagcttaaacctgaccatgtcaatgatagccatggtgcatactccggttctgcattagccattgacgataagctttttcttttttatactggtaatgtccgtgacatgaaatggaaccgtgacccccgccaaattggagcatggatgacaaatgatggcaagattacaaaatttgataaagtccttatttcacaaccaaatgatgtcactgagcattttcgtgaccctcagattttcaattatgataatcaattctatgctgttatcggggcgcaaaatagtaaaaaatgcggattcattaaattatataaagcacttaataatgacatccatcattgggagtttgtgggagatttagattttggtggtactggatctgagtatatgattgaatgtccaaatattatttttgtcaaaggaaaacctgtattactttatagtcctcaaggactagataaaaacgaattggactaccaaaacatttatccaaatacctacaaaatcggacaatatttcgatgctaactcatctaagatagttgaaccatcccctatctataatttagattatggttttgaagcctatgctactcaaggatttaacacttctgatggtcgtgcctttatcgtgagttggataggcttgccagatattgattatcctagcgatcaatttgattatcaaggagctatgagtttagttaaagagttaagcataaaaaatgggaacctttatcaatatcccgttcctgctatgaaaaatcttcgtcaacatcaagcagaatttaaaacacaacttcaaactaacaacacctatgaattagaattactggttcctagaaatgatctttcttcatttgttctctttgctaatccgaaaggacaaggactatccattactattgatactgtaaaggggaaagttatcattgaccgctcacaagccggacagcagtacgccacagaatttggtactagtcgccagtgtgacattccaaaagatgctactagtatcaatatttttatcgataagtccatctttgaaatctttataaataaaggagaaaaagtatttacgggacgagtctttccagatgcagaacaatcagggattcaactaaaagaagggcacgttcatggtaaatattttgaattaaaatattaatatggttgcaaaattaacagatgttgctgcacttgccggtgttagcccaacgactgtatcacgcgttattaacaaaaaaggctatttatctcaaaaaacagtcaccaaagtcaatgaagccatgagaacccttggttataaacctaataatttagcacgtagcttacagggaaagtccgctaaattaattggactcattttccccaacatccgtaacattttttacgctgaattaattgaacaccttgaaattgagttgtttaagcatggttataaaactatcttatgtaatagtgaaaaggatcctatcaaagaaaaagaatacctcgaaatgctaggagcaaatcaagtagacggtatcatttcaagtagtcacaacctaggaattgatgattacgagaaagttgaggctcccatagtagcattcgatagaaatttagctccacacatccctatcgtctcatctgataatttctttggaggaaaaatggctgctcaaacccttaaaaaacatggctgtcaaaagatgattatgattacagggaatgataattcagattctcctactggacttaggcggctaggtttttcctatgaatcaaaggaatccaaagttatcacagtcacaaatgggctatctaacatgagacgtgagatggaattaaaatcaattatctcgactcacaaaccagatggtatttttacatcagacgacttaactgctttattagtaatcaaacttatcagccaactagggttgtccattccagaagatatcaaagtgattggatatgatggtacaagtttcattcaagattacgtcccacatctaaccactattaaacaacctattcgagaaattgcgcaattgatggttgagatactcctagctaagattgaggggcaaaagacaaataaggattatattttaccagtcagtctcatccctggtagtagcgtttaggaaatcatatttatgaaataatttttagtaccgatagttatttttcaaagcaaattaaaaatgtggaagaagattcttccacatttttaattttcatttgttataaattgacttaataaaccattgacaaattttgctgacgtctcatctgaatattttttagcaatctcgataatctcatttagagctacacgatcaggcgtttcatcaaaatatttaatttcatagaggcctaagcgtaagagagatttatcaaccaatgttagacgttctaagctccatcctgattttaagtgactagaaatcaaagtatctaattcatctttgtgatctacaacaccattaacaagattaagtaaaaagattggaacctctaaaactttgtcttcagatactgttttatcataaccataagcaaagtgagccgcatcaataaactctccaccagtttctaagctaaatagtgtttgaaaagcacgttcacgtaaatcacgtcttgaatctttaaatacactagtcatctaagaaatcctcatcaaacaatgacttcaagtctggttttggtgttttctctggaacaataccttcaacatggatattgaccgaagaaatttttacttctgccatgtcatatacagctgttttgacagcttgttgaatagcaattgaaactgctggtacatttacaccatactgcaagtaaacataaatatctgcagctactgtatcatcttcttcatttttaaggtagacacctctacctagagatttcttactaaggctatccgttaccgctttgttacgtaacgaatgaacaccatcaactttagttgcagcaatacctgtaattacctcaagtacacgtggtgaaatgacaatttctccaagattttcagttgtcatagcttatcctttcttttagtgtttactaaggtttttccttaatagagtaaattcatcatgaatctacttaacacttttttgagagtcattaggcgcgtgaaacgtaagttccttctgctgtattgattactaacttttgtccagcttcaataaaatctggaacgttaacaacaagtcctgtttccatagttgcaggttttcctgaaccagttacagtagcacctttgattgatggttgagtttcagcaactgtcaattcaacagttgttggaatttgaacaccaataacttctgttccatagaattgaatttttacttctgagttttcaagaatgtagagtaattcattttcaatgttaacagttggaatttcatattgatcgtaagtttcattattcatgaagtaagctgtatcatccatcttataaaggtattgagcaggtacagtttcaataatagcttgctcaaatttttcttcaggacggtaacttgtatcaaaagttgaaccagtacgaacatcacgcaatttcatacgcatgattgtgttacctttacctggtttgtggtggctagcttcaagaacacggattaatttcccatcagccgtttcaaaagtcatgcctgctttaagcttacttgcttcaatcatttattaatacctctttgtaaaaattatttatcaactcattttatcacaaataacctgctttctcaaatagtttattgatttggtatgtgtctgatttcttgataaataaataaaatcaccaagagggcgtaaataagactgaagcacttgacactttcctcttacttcagttttgataacagttttaatattataccgatatcttgactaagattgaaatactgtttaggtgtttttagtgactttttagtaaattttgataaaggtagtaaactatagttgtcttattgaaacagataaaataaatcacctacggagctattcgtatgaaaatgtagttattctcgatataagttttagatacgaacttaatttgctctattgaagctggtaaaggaaatcggggtggtgttagtggacgtgcgctaagcattggtactgagcttggtgataccaatcttgcttactacatcaggtagctctctgttttagtgccatatgcaattggaataagagctgtcattggtattgaaggagccctagtccactgatcattgaattactaatttaggaggtggaatgatgaattttaatatgtctcattatagaaagttacaactatgtcgttttctaatcgtacagatacctgcgctggctttattagctattcttttatacgggattttcctaaagtacagtctattttcaaaagtattttttcttatcttttaggggttgaaatagttatcaattttgggaagtacataccagtttacaccaaccacaatttgtcgagtaaagaattgtaatttagtaaagcccttttcgttttcttctgataagtgtatcatgacatctatcaatagcatattcacactagtagcatattgatttgtttttgagtagaatttactttttagattatttctattctacactagtctttccctttggaagattctttccctctgtatttttccatttttcaatgagacgagaaactctttcttcctcctcatcatggtaaccttcaaaaacaacctcatcaatatcttcttgattaaaatagtaaacttgttcaagatttaaaccctcaggaaaaattccacctaggtaatcaaaataaacttcttgtccttcttgctcaacaattgcacctctatttacaataactaatttttgattgccatcaataagatagacaacactccctactggtaataacatacttcagttctccccaatataataatttttcccatttaacgatggttgaaactcaatgaactttataaaaaataaactgtttgaaaaaataaatccaaataaaaataagtttgaaaagttttcgtcccacaatgccattccccatagaacgatataagaaattatgattgataatattactataaatgggctcttccgtttttgattattatatttcaaaaaactagatttatatttggaaagatctaatgctttatttctctgatttagctaaaacaagactaaatatgctcaataaaataaaaagataaaaatgttctaatattaaatgcgatcttgttaagtatgcaatatttatattttttggaaaaattgagatatgaactaaataaaataaaaataaaattgtaaaagtttttaaagataaaggcgactttttttgtttactaaaaaattcttataatccgcagtcacatcataaatttgatatttttctactctttctggaaaaatacctataaaataatcttttatatcactaggattggcataatcaataatgtaataacgtccactaatactaactagataatatctaaaattaagttttgctacaagctcaacccgtctataactttttattcccattagttcacgtacctaactatttatttttgtaaaatgtttatcaatattgttaattacatttcctgtactacttataacatttctaaatgatttagaattattatacaatgcttttacaccaatcgaagcaactgctcctatcacaggtgcaatttcagtaccaattgctaatatcttattcaatcacaactccttttatatattggttccactattactatttttttctaattcgatcaataccttttttcttttataaggtctatattccaatattaatattagtacagacacaaaaagtattcccaaaataatgaataaattgaaatctaaaacttgtagaaataatttaaataaaagtaggatactaaaacttaatatgaaagagattgaaattattaatatattatgtactttagcatctttaataaatttttttaactgtccagggaaaatttctagctcttcataatcattttttcttctcatcaattttactgtaaatcctgaaactagtatcaataaagataaatatacaatagaaaataaaattgaaaaatttgaaatttctagattttcacttatactttgaattatttttccaataatagttgaaataataggagttagtagcattatacctgtgctattttttttagattagatttatataattttttcgttttcatatcataataaacagcattatcatgaaaccatcctaaattaataagattatttgtttctatttccgttttcaaatcttgctccttaattatataaagtacctaaactattattagctgaaatggatttaccaatatttttgatagtttcttgtccataattgatgatatcatctttatagttatcatacacccaatcaaatgccatattagcataaactggatttacatctattgaggtcagcaacaatatcttttctcttttttgtaaattatttttgcaattcgagattcccagcagtactaattttagatgttgataatagatggatcagctattctattatcaacatctaaaactttctgtgaaaaatcattaggaataatgactattaactggtgatcaccttttttaggccattttcagtaatcccatgactaacaattgaccaattttgagaattatctcgttcaatatatttaacataactggcccttagcttaaacgataaaaccttcaaggaagataggcatatactctatcttcctctttactcttccatccctagtgttacctctggaacatcatgttgaacataagcaactccttttgcttccataagttcaatagcaaatgggtgtgggcgataattagctttataagtaattttcttaaccccggcttgcaagagcgccttggtgcaattgatacaaggaaaatgcgtcacataaatttctgtattattagtagaaataccttctttagcacactgaataagggcattcatctcagcatgaacagtcctaatacagtgaccatcttccatataatgtcccacttcgttacagttatctgtctcagagactcctccgttataacctgtagcaatgatgcgattatttttgactaaaacagctccaacaaaagcacggtcacaggtagaacgtttagaaatcaactctgcatttgccataaaataatcttcccaagaaagtctattcattctattttcctttaaagtacaattaattctttaggtgcagatgtcaatacttcgcaacctgtttccgttattaataaatcatcttcaatacgaacaccgtatttattatcgagatatattcctggctcgtcagtcactaccatcccagatgcaatcactccctctgacttaccaaaataaggaatttcatgaacatcaagccccataccatgccctataccgtgggtaaaatgattaccgtatccagaattttcaatgacttgtcgcgccaagtaatcataatcacaacgcttcattcctgattttacattaccaataatagcttgattacttttcaaaacgatatcgtaaatctcgcgttcctgatcagtgacatgaccgatatgaatcgtacgtgtcatatcactaacatagtgctgatagtaacaaccaaaatctaaagtcagagtttctcccgattgaatagtcttctgactcgcaaccccatgtggcatcgctgatcgatatccagatgctacaataaaatcaaatgaaggaccagttgctcctaattctctcatgcgaaagtctaaaaaattagcaacttgcaattcagttgttcgatcaggctttataaaatccaacacatctaaaaaagcttggtccgaaatacgacaggcttgacggatgatcgcaagttatgttacatctttaatcatacgtaacttttcaacaacagatggagcttctatcaagcgataatcttcaaaaacttccaccatatgtttgtacatatgataagaaatatcagtttcaaaaccaatcgctatcaatgcgtcatcgcgaataattttcaaaatagccgcaagtggttctctgctaatgataatatcaaactctcttacagtattctttgctatcaaggcatatcgtgaatctgtaacaaaaatccggtgttttggactaatgagtaccgttgcattagttcctgaaaaaccagtcaaataaaaaatatttgttaaatttgttattaagagtgcgtcacatgataattgtgaaattgctgtttgacatctagttagacgttgttcaaaacccataagaaacctcgctattctaaccttaattaggttaattttatcatcttttaaaacatttagctataagaaaagcaactcatttcagttgcttttactttactattcttttatattaagagcttcttttaatgctttaacttgcatctcagcataagcttctggatttgtcttagctaatgtctttatctccatagctttcactgggtttacttttgcttgcgaagtcatttgttcttttagtttagccgcagccgattctaagtgttcggactgctctttagtcaaaactagccaagtttttcgtggtattttagcaactgatttctgagaaatcaattctccattttcacctgcaaagccataaagtagtttcgaaagactatctttccacacataacgtttagtctttgttgttactgtggcttttttcacatcagctaattggtagctagcagattttttcacagcacttgtcacttcttttgtatttggaacaaagtgagcttttgcttctttttgatttaaatctgttcgataaactaaaacattattactcgaatgagtaccaatctctttataaatcatgagaccaaatggagccttactatcacccgcactataaatctcacgtgtctttgtcttagtttcaatagtcatacctgtatgattaataaagtgatccgttaacatccaaactgaggcaaacaacaaagctaatgagagaagacctagaatataccgtagagcttttggacgaatcaacatccatgtgacaaatgtcaaaatagttgccagtgcaataatcaaaataatcatgctatacctccttttccgtctcaataattttcccttttctcaggaaaagagataccagtaaaccaagaaccgcaaatacaaaaccaatggcaaaagaaacatggaagccatcaagactagcattcaacatctgatttgcatattttaaaggattcattgttagcaaatcttttgatggtttattgttggtgataatattttgagcaacacttgaaagcaatgcaactacaactgctgaagcaatttgacgagcagtattattagctgctgttccatgtgcggcctcatgtggtggaagtgcgctcatcgcacttgctgtcaatggcatcataaccatagcaataccaaacatacgtactgcatataagagggtaataaaatgatctggtgttgtagtcgttaagaaaacaaaaggtaacgtcgctacacctagtatggtaaaaccaatcatagccatacgtcttgcaccaactttatcatatacagctccagaaattggactaactatccccatcatcaaggcacctggtaataaagctaaaccagaatcaagtgcagagagaccatgaacattttgcaagtaaagcggtagcatcatttcaacacccatcatcgccatcattgaaagtgcaatagctgctgttgttactgagaattgtttatttttgaaaacacggatatctaagaacggtgtttctagttttaattgacgatgaatgaataaggcgataaaaataataccaaccataataggagaaataacatatccaatatctccccatccataagttgccacatttgtgaagccccacaaaaagctaccaaagccaattattgaaaggataagggaaggcacttccaatttaactgacttattatcaaccacatcttttagaacaaagggggataaaattgtagtgaccgttaaaattagtaaaggaagaaggaaaattgcacgccatgttaaatcatgccctgcaaaatgaaattcttgttttaaaatccaccctgctaatgtaggcccaatagctggggcaagaccaaccaccaaaccattaagtcccatagcggcaccacgctgctctggaggaaaaacattcaccataacaacctgcatcaaaggcatagaaatccctacagaaatcgcttgaataatacgtcctactaaaaaaaggttccagttagatgtaggtgctaacgtcgtcattaacagtccaataagtaaaacaacgtaggatgtcacatacaaccattttgttgaaaaacgtgtcgctaaataagctgaaacaggaatcataatcccattcgctaataaaaaccatgttgttgcttgttgagccgttgacaacgaaatgttaaagctattcatcaaagttgggatagccgttcccaaacttgtctgatttaatacccctgcaaatgtagcaatcaacaataaggtgatcatggctgtacgattatatggtttgccatgaatatcatgttttgcttttgtagtcattttatctccaatctctatttctgattttaactaatatcttttaagaataacaaataggtcttataaggttattttttgattttttaatcaagaaataatattattttctgaaaaaatcattattttagttatcgtgagaactattttataatagctaaattttattgtcaagaaaaagattctcatagaaactatttttttcaaaacatcattatttcctttttttaaaatatctccccactatttttcctaataaagcgttctccatttaatgacttctacgcaatgttagcttacaaaaaggaactgagtaatattactcagctcccaataaactatcttgctaacttctcttttaaataatatcctgtataggatttaggattttcagcaacttcttctggtgttccgatagctacaatttgtccgccaccaatacctccttcagggccaagatcaataatgtggtcagcagttttaataacatcaaggttatgctcaataacaagcactgtattaccatcatctacaaaacgatccaaaaccttaagtaaacgagcaatatcatctgcatgaagccccgttgttggttcgtctaatatgtaaagactcttacctgtcgaacgcttatgtaattcacttgccagcttcattcgctgagcttctcctcctgataaggttgtagctggttgccccaaagtgacatatcccaaaccaacatccttaatagtctgtaacttacgagcaattttaggaatagctgcaaaaaatgtaactgcatcattcactgtcatatcaagaatttgtgcaatatttttttctttgtaatgtacttccagagtctcactattatagcgcgtgccgtggcatacttcacaaggaacgtagacatctggtaaaaaatgcatctcaattttgatgataccatcgccagaacaagactcacaacgtccacctttgacgttaaatgagaagcgtccttttttataacctcgaatctttgcctcattagtttgagcaaaaagatcacgaatatcatcaaaaacacctgtataggttgcgggattagaacgtggagtccgaccaattggactttgatcaatatcaatcaatcgatcaacatattcaatgccttctaaagaaacatatttacctggtttatctgagttacggttaagcttctgcgcaacagcttttttcaaaatactattaattaaggttgattttccagaacctgagacaccagttacggcaataaatttaccgagagggaacttgacatctaaattttgtaggttgttttctgccgcacctttgatttctaaaaagcgaccattacctactcttcgttcagatggcacaggaatcactttcttacctgacaaatattgtcctgtaatagatttagtatttttagctacttgcttcggtgtaccagaggccacaatctcaccaccaaacgcaccagcgccaggtcccacatcgattaaccaatcagctgccatcattgtatcttcatcatgttcaacaacaataagcgtattacccaaatcacgcattttcttaagactatcaatcaaacggtcattgtctcgctgatgaagtccaatggacggctcatcaagtacataaaggacacctgataaattagacccaatttgagtagccaaacgaatacgttgactctcgcccccggaaagtgttcctgcagaacgtgacagatttaaataattaagtccaacattatttaagaaacttagacggtcatggatttctttgataattggtcgagcaattaattgttcatttgaagataaacgcaatgtttctaaaagttctaaatggtctgctatcgataaatctgagacttgcccaatattaagaccttcttctcccccaactcttacgcaaagtgcttgatcattgagacgatagccatgacaagtgttacattttagctcgttcatatattctcgcataacattgcgtgtgtaatcgctattagtttcatggtaacgacgattaatattattgacaaccccttcaaaaggcaaatcaatatttctctcgcctccaaaatcgttaatataatggaaatggaactctcgttcgcctgaaccatatagggctaggtcctgctccgccttgcttaatttttcaaatggcgtatccatatcaacaccaaattgagtcatagcttgctctagcatcgttggataataatttgatgaaattggattccaaggaactaaggccccttctctaagggtcttacttctatctggaataaccaaatctatatctacttctaacttaattcctaagccatcacaggtcggacaagaaccaaagggagcattaaaagaaaaaaggcgtggctctaattcaggaacagtaaaaccacattcaggacaagaataatgttctgaaaacaataactcattgccatccattgtatcaataacgacataaccatccgacaaacgtagagccgcttcaacggaatcaaataagcgggaacgaatgccctctttattaattaatcgatctactacaatatcaatattgtgcatcttactttttgataattcaggcacctcagtaacatcgtgaatatcaccatcaatacgaacacgaacgtaaccatctttttgtattttctcaaatgttgatttgtgttgtcctttttttcgacgtataattggggctaaaatttgcatctttgttcgctctggaagcgctagtaccttatccacaatttgctctacagaagatgctgtgatggctccgtgaccattgatacaatatggggttccaacacgagcataaagcaaacgtaaataatcgttaatttctgttacagtcccaacagtagagcgaggattcttacttgttgttttctgatcaatagaaatagctggactaaggccatcaatagaatctacatcaggcttttccatatttcccaaaaattggcgcgcgtaagcagaaagactttcaacgtaacgacgttgtccttctgcatagatagtgtcaaaggccaaactagacttacctgatcctgatagtcccgtaacgacaactaacttgtctcgtggaatgtcgacacttatattttttaaattgtgagctcttgctcctcttatcattaatttatcttgcataatgttgtgcctcagcactcctttttgaatagtgttgacttattatatcaaattttaataaagtcagtatttttttagttttaaatttcatagaaaaaagagatgaactaatacgttcatactctttgttattatcttctttgttgtggtgccactggtgccattgagctttgaatattatatttacgttgtaaataaaagcgcaaaccaaacgatgctaaagcaataataaacaaaacaacctcaggaagtttaggattaatagttgcaggtagaagaggtactactgcaaataaggcaaaccaaactaacataactagtgccagtactgcgaaagatttaagccagcctggtctttcagattttggtttacccatatggcgataaatatagtaataagtaacgtacatggccgcaccaccaccaaaaccaagagttaaaattgaaataagccctgtattgacattagattgaccaaatagcaacattaaaccattcaaagcagttactaagccaagaaatagtaaggaagtatctaaccacatcaaccaaggattggtatttttttgtacagatactctagctttatcctcaggtcgctcagtgaatgaggctgcccaagtagttggtgctcctaagagtgagcgtgcggtaattccttttttctgattatctataatctctgggagatgttcttctaaaatagctttgatttctgcatctgattttccatcagctaaaagttgattagttgcaatatgaacaaactcttgattctttttagttaagtcttgtaaagtcatgtgaactccttgattaatatactattaaaaccattttttacgaataaaataaaatacaacaaatgaactcatcaaaaaggccaaaagaacaacatagataaagccatgtgcgagaccattcaaaggcatccaattattttgaaagttcatcccatacgccgaaaaaataaccgttggaatatccaatgtcatagttactagggctaaggttttcataatggtattctgattattaccgatgattgaagcagtcgtttctgtcatggcatttaagacattttcatagatatttgccatttcaatagcctgctgagtttcgatcaatgtatcttcaagcagatcttcatcttcaatgtatttttttaaactactggtactactggtcaattttttgacgattcgctcattaaattttaaagaggcctttagatagacaatagatttttccaattccatcatatcgatcaattgctcatttcgagttgcactctctagttgtgcttcaattttatcgctctgcctatcgatagtacgcaaagcctgtaagtataattcggcattgcgataaagcaattggaaaacaaaacgtgtcttcataaaggtataaaaatttttgacacgtcgtctataaaagtgatcaaacagcgtcaaatgttctaggcaagtagtaataacagcgttgtcagtaacgataatgcccataggaatagtcatataataacttttgttattgcgttcttcataggtaggaacgtcaacaataactaaagtataatcatcttcaaccgagatacgggaagtttcttccacatcgaggggagcacgtaaatcatcaatatcaataccaaattgatcagctacttgttcggattcttcctgggagggattaaccagatttatccaagcacctggctcgaatgtttcaatttctttaaattcaattgccgttgaaagaaacatttgcttcatggcgattcctcctttgttataaaaaatccataccttaatattatacaggaaaaccatttgttttgcacggttaatacggtggtatcctaaatttttctattatttgactcgtaaataccaataataatggtaaaaagaataaaaaaatagccgctagggctattttatattaatcttcatttacgtaaggcataagagccataacacgagcacgtttgattgctgttgttactttacgttggtttttagctgaagttcctgttacacgacgtggtaaaatttttccacgttctgaaacgaaacggctaagaagctctgtatctttgtaatcaacatattcaatcttgttagctgcgatataatcaacttttttacggcgtttgaatccgccacgacgttgttgagccatgtttatttctcctttatagttttaaattctgtccatctattatattagaatggtagatcatcatctgaaatatccattggatttgagttaccaaacggactctcatcacgactaaaattaggtgtttgttgagaagaagctgaataactattatttgacggagcattgttatagccaccgttattataagagttaggtgaaccaccttctcgtgtagcacgactttccaataattggaaactttccgcaacaacttctgttacatagacacgttgaccttgttggttttcataattacgcgtttggatacgacctgtaattccaaccaaagcacctttttttgcccagttagccaagttttcagcttgttggcgccaaataacacagttaataaaatcagcctcacgttcgccagattgatttttaaaattacgattaactgcaagtgaaaaagtggctaccgcttgattacttggtgtataacgaagttctgcatcacgggtcatgcgacctacaagtactacattattaatcataaactaccttcttagtctactttaacgatcatgtgacgaagaatgtcaccgttgatttttgaaagacgatcaaactcattaagagctactgcatcttcagcttcaacgttaacgatatggtaaagtccttcagtgaaatcttggatttcgtatgcaagacgacgtttttcccaatcttttgattcaacaacagttgcaccgttgtcagataagatagaatcaaaacgtgctaccaaagcgtttttagcttcttcttcaatgtttggacgaataatataaagaatttcgtatttagccattgatatgttcctccttttggtctaatgactcatgaatttttcatgagtaagtgaggttatgctcacaagatattattatagtagaaataagttaataatgcaaggtttttatgtttttatttccctgatatcatttaaagacattttttatttttctttattgaaatatgccttatatcaaacctatgtagccattttcttttactgacttatgttcaatccccattctataattcaattaaaaaataaaaaggcgaggtttacacctcaccttcaacatattatttaaagaattctttattggtttaagttttcgttggagaaaaattcagtgtctccgattttatatttttaaatattaaaatactatttagggagtccctcattatgttttattacctttggtaacaccaaaacatacacgaacttttattcatatgtgttaccattttacatctttcatattgagatatttgattagcaatacctccttgactaacaaaaattactaacacatctaggggtataccctagtttatatttgttcatgattacctcaagcaagcatgcgctaatggtaatgaactattaccacattgtctgtcttccttaaattatataaggacttatgtgtcaccgttactgtagcgacctacatctaaacctaacataagtgcccctccaactatttctaggaaatgaagaaaacttcaaatccttgtgactgtttgcaacatcaatgcattgataacaattttagtgtatcgccattcttatagcgacccatattaaaaattaacataagcgctacctccattaactaaagttagcttgcctaccaatctttcttttggagactagtctccattcttatacctagagatattgtaatagatcatggataacctccttgatttaaactttatctttataaattaattatagtgtaaacgcttccttaagtcaagaaaaaaatattgatgcaacatttttcttcatcattaagtacgatctagtcaacatacctctttgtcaaatcctctttctttgatacaattaatctatgatagatttaaaagactatggaattgagatgtggcctgaagatagaatcgcttcttttcgtcgcacacttttagggtggtatgaccaagaaaaacgtgatctcccttggcgaagaactactaatccatactatatttgggtttctgaaatcatgttgcaacaaacacaagttaatacagtaatcccttattataaacgttttctagagtggtttcctcaaataaaagatttggcagacgctcctgaagaacaattactaaaggcatgggagggactaggctattattctcgggtgcgtaatatgcaaaaggctgcacagcaagtgatggttgattttggtggcatatttcctcacacttatgatgatattgcttcattaaaagggattggtccttatactgcaggtgctatcgccagcatctcattcaacttaccagagcctgctgttgatggcaatgtgatgcgtgtcatggctcgtttgtttgaagttaattatgacatcggtgaccctaaaaatcgtaaaatttttcaagctattatggaaatactaattgaccctgacagacccggtgattttaaccaagcacttatggatctgggtacagacatcgaatccgctaagacacctagacctgatgaaagccctattcgtttctttaatgctgcttatttgaatggtacttatagtaaatatcccataaaaaatactaagaaaaagcctaaaccaatgcgaattcaggcttttgtcattcgtaaccaaaatggtcaatatctactggagaaaaatactaaagggagacttctagggggtttttggtcatttcctattatcgaaacgtcacctctttctcaacaattagatttatttgatgacaatcaatccaaccccataatctggcaaacccaaaatgaaactttccaaagagaatatcaattaaagccccaatggactgataatcactttccaaatattaagcacacttttagtcaccagaagtggacaatagaactcatagagggggtggtcaaagcaacagatttacctaatgctcctcacctaaagtgggtagcaattgaggacttttctctgtatccctttgcaacaccacaaaagaaaatgctagagacctacttaaaacagaaaaatgcttaatcacaagtgaactatgacggttcactttttgtttacaattcctttacgccgctgtaaagttttcctcagattatcttttaataccctataaatagtggtctatccctaatgtcaaatacatttgatagacccgttagcttatcatccttatactaatattatgaaaggagatatttatggaaattggtcagcaaattattcgctaccgtaaacaacaagcgctctcgcaagaagaattagccgagaaagtctatgtaagccgtcagagcatatctaactgggaaaatgacaaaacttacccagacatccatagcctcttactcctaagtcaaatttttcaagtgagcttagaccaactaattaaaggagacattgagaaaatgaaatataccatcactcaggttgataaaaagaattttgaacgagataccaaagtaatggtgacattgatgatactattaatgatttcaagttatccattagtctatttcttagagtggctaggacttggcatttttgttttattatcgataattactatgacttatgctaatcgtgtggaacgttttaagaaaaaatatgatgtgcaaacttataaggaaatcctagctgtttcaagtggaaaattattagacgaaatcgaaaaacgggaagaaagagcaaaacttccttatcagaaaccccttattgtcactgtatttttcctcattactgttgccaccttttttgcaagtcgttttattttcacatggttgttccatttaagttagtagataataaaataaagctcagcgtgacactgggctttattttatttaactcaattcagcaataatagctttcagttggtctttagtatgaacacctgcaacttgtttaaccacttctccgtcttttttaaacatcaatgttggaattgacataataccaaactgacgggcagtttccggattctcatcaacatccattttcaaaattttgagttcatcttcatcgatttcttgagataactgttctaagattggtgcttgcatacgacatggaccacaccaagttgcccaaaaatcaatgagtactaaaccttctttagtttcttctacaaatgtagcatctgttacttctaatgccatcttttttctccatttcatcttaatgataagcctattgtacaagaatctagttgtttttgaaactatttgctacgaactcgctaaataaataaacaaagccctaaaatcaagccaataaggtaacctacaataacatccttaggatagtgaatacctgctatcacacggcaaattgccaatagaaccgataatattaaacaaactattccaaagtaaacataatatcgtaacaaacacatactaatcatcgtagctgaaaaaacatgtctgctaggcattgaccttccctcagtatccttataaattaaaggtttaatattccatttttcatatggtcgtggaaaatcaaggcgtttcctaatgtaagacaaagctataaagccaacagcagggataattaatagccttaaccataattgaaatgtcatcccttgccaaagagtaaatatcagaaaagatggatagagtatgtacatcattcctgtgactatttttagtaaaaaatttaaaagaattattaactgtggggattttctaaaaggttgagatagtttggcataaaattgttcatatgattccataatttaccctaacgttacaattgtggcgccagatccccctgcattttgtggggcataagcaaaatgcttaacgtgcttattacgacgaagatattttgtcactccctcacggataacgcctgtaccaataccatgaatgatatcaacttgtcccatattgttaagcaatgcttgatcaataaaattatctaactcttgcatagcttcttcgtatcttttacctctaagatcaagtcgagctcttggtccagaactatcagcctttttaaccacattaatctgtttacttttgactttctgttcttcttggactctaacaagggtaaattcatcttgtgttaatgtcattttgataattcccacttgtgcttcccaacgtccatcttttaattgactagttaaggtacctcgctgtccatagctagtcactataatatcatcaccaattctaggagcacgagctgctttaatttttttagccttatttaagactttattttttgataaatcaacttgaggtgctaatttttttatttgtgccttagcatctataatttcgtgaggttttaattggctcttatcattgagtttttttaagatagtatcactctcattcaaagccatatctacaatttcttgagcttcttgatagattttttctaactctttatcgcgctcatgtgaaaattcattatagagtttcttaaccgcacgattgaatttgaggttttcttgttcaacttctttaatatgatccagtcttctacgtgtctcaagtgtctgtgcctctaactgttcaataatacggttaacatctgagtcagaatctgtcatctgcttagcttgtttaacaataaatggagctaaaccaaggcgagaagcaatttcaaatgcatttgatcgtccaggaactccttgcataaagcgatacgtagggctaagcgtttcggcatcaaattccatgctcgcattctctacaaaatttgtctcaatcccataagcttttaattctggatagtgcgtggtcgccatcgttttgatattacttaacctaaggtgttctaaaatagccatagccaaactagcaccttcttgaggatccgttcctgctcccagttcatcaaagaggactaaactattgtggtcagcctcgtttaaaatactgactatgtgcgtcatatgactagaaaaagttgatagactttgttcaatagattgctcatcgccaatatctgcaaagatattgttaaatactgcaattttactacctttatccgctaatactggcaaaccagactgtcccattaattgtgctaaaccgagtgtttttagcataatcgtcttaccaccagtattgggaccagtgatgacaattgcagttaaatcttgatcaaaatgtaagtcattagccacagggttacttaacagaggatgacgaacattgattaatgctaacgtgctgtcattagaaatctcaggtatcgtcgccttattatcagacataaaaagatatttagcccttacaaaatcaagatgcccaagaatccatgcattatttctaatagtggcgacatggggtcttaacaagtctgaaaatgcgtgtaaaatacgactttcttcatgacgttcgtcagctctaagctgcgttatctcttcgtttagtgtaactacagcacgaggctcaatataaacagtacttcctgaagaagagatgtcatgaaccacaccagaaatacgattccgataagtattttttactggtaggacacttcgtccactacgactagcgattagattctctgataaaagctctgctttttccttaagcatatcctgtaaaatctgacgaacccgtcgttcactgtttgttaattgacgacggatacgctctaattctggactcgcaaaatgttctaaaaaaccaccatcattgatagcttgaaaagacccttgcagattagggaattgttccaaattttcaaacaaacgatccaaagattggaaagaaacattatccaaatcagaataaaagtgaatcatatccgaagaactctgtaaaacttttttgatagccaaaagttcttgaatattaagatcagctgaaagctctaagcgttttaaactctcagagattgaacttaggctgactatgccaaatgagtgatgttcaacaaaaatctgttccatgtcagaaatttcattaaaacttttttctattttaggagcctccgtcatcggctccagctctgataattcttcttgtgattgttctgtcttgagataaggtaatatcaattccttaactttgttaaattctaactgttctaaaatcttgttattcatactcttcattatacctaaatttatcacaaaatgacaacgttaaaaaggttggaactcttactccaaccttactaaacattatattcaaagacctaccgcccaagtccttaccaaaaactgtgagaagaatggtaagtcgttaattaaaaatctaacaaacagactattccataacttttcttgaacaaatgacatagggactgttgccagaatagtcaaacacatactcataaataagagacaaaccagaacggctaaaaaaccactaataatattattttgcaagctatcaaaatgttcaactggtgctaaatgtagtaaaacacctaacaagcgacctactaagtaagataaactgtagataaaaacaaaggcaacacctgcataataaacatgactcaattgaaatttgctaatatctttaaaaaagtaaacttctactccttgtacaggattagaatacggtacccataacgtaatctgactagctaattcttggtaaaattgactagcaatcatcaaagataccattgacattaacacgtaaaagacttgtaaaaaaatacctctactgtagccaatataaaaatgccaaataacaataatcagcaaaagcaatgatagcatgattaatcctcactcactttttctttaatgtccgaaatcgttttggagcgtaacttattgagctcatcttccattttttcaatgtcaatttctcgacttagttgcactgataaagcattaattgccatgagaatagcaatcgtttcattatcagcattaggtaatttttctttaatagcttcatacttttctgtagctacacgctcaatctcttccataaaaaggttgtctttatctgtcgtcaatgtgagaggcttatctccaaagacaaatttataacgatttttctgactattatttatttttgtttccatactatacctctgctagcattataccgtaaaatagggctttcgtaaaattctaccccttatcattacttgtctattcccttattcctcttttttatgatagaatattgtctatgaacacaatcgtcatgcaagcagataaaaaattgcaagaaaagataagaaccgatttagctcaacatcatataagtaataacaatccttatgtggtattttcagctaaaatatcaggagctactgttcttttatatacttctggaaaacttgtcttccagggttctaacgcttcacatatcgcccaaaagtatggttttattgagcaaaaagaaagttgttcctctgagagtcaagatattcccataattggtactgatgaagtgggaaatggctcttactttggtggactggcagtggtagctagttttgtaactcctaaggaccatgcttacctcaaaaaattaggtgttggtgattcaaaaacacttactgatcaaaaaattaagcaaatcgcgcctcttttggaaaaagcaattccacacaaagcattattgttatcgcctcaaaaatataatcaagtggttagtccaaataacaaacataatgctgtctccgtaaaagttgctttacacaatcaagctatcttccttcttcttcaagatggttttgaaccagaaaaaatcgttattgatgcttttactagctccaaaaactatcaaaattatttgaaaaatgaaaagaatcaatttaaacaaacgattactctggaagaaaaagctgaaaataaatatctagctgtagcggtcagttctattattgcacgtaatctattcttagaaaaccttaacaaattaagcgacgacgtaggatataaacttccaagtggagctggtcaccaatctgataaggtcgctagccaattactcaaagcttatggtatctcttcgcttgaacactgcgcaaaacttcattttgccaacaccaaaaaagcacaagcattattaaaataaatagcagggaaaattatgaaagaatttattaaagaatggggtgtctttatcctcatcctctcactttttttactatcgcgtatctttttatggcaattcgttaaagttgacggacactccatggatccaactttagctgacaaggaacagctagtagttctcaaacaaacaaaaatcaatcgattcgatattgtagtggctaacgaagaagaaggcggccaaaagaaaaaaattgttaaacgtgtcattggtatgccaggtgatgtcatcaaatataaaaatgacaccttaactattaacaataaaaaaacagaagaaccttacctcaaggaatatactaaattatttaaaaaggataaattacaggaaaaatattcgtataacccacttttccaagacctagcacaaagctctaccgctttcaccactgacagcaatggcagcagcgaatttactactgtcgtgcctaaaggccactactatcttgttggtgatgaccgaattgtctctaaagatagtcgtgccgtcggtcccttcaaaaaatcaacgattgtgggagaggttaaattccgcttctggccaattcgtcgttttggaactatcaactaaaggaaattaaaaattcacctgacaaaagttgaaatagcatattatattgaaaatagggagtgacaaatccatttaaaatagggatttacaatcactccctttaactgtttattaaaaaggaaggtacaatggaagtattttttacaggaaccattgaacgcattatatttgaaaatgccagcaatttttttaaaatattacttctggaaatcgaagatacggatagcgattttgatgatgtagaagtaattattactggtactatggccgacgttatagagggagaagaatatactttttggggaacactaacccaacatccaaaatacggcgagcaactacaaagtgtacgctatgaaagagccaagcctacttcaggtggccttgtgaaatacttttctagcgaacaatttaaaggaattggtaaaaagactgcccaacgcatcgtagaactctatggagataataccattgataaaatccttgaatcccctgaacagttaagtacaatctcaggactatcaaaaattaatagagaagcattcatcgctaaactgaaactcaattatggaacagagcaagttttagctaaactcgctgaatatgggttaagcaatcgtgctgctattcaaatatttgatcactataaagaagaatcacttgaagtgataaacgaaaatccttatcaacttgttgaggatatccaaggtatcggttttaaaatagctgaccaacttgctgaacaagtcggtattgaaagtgattctcctaaacgctttcgtgctgctattattcatactttagttgagtcttctatggagcaaggagatacctatattgaggctcgtactctcttggaaaaaaccattactctccttgaagaagctcgtcaaatcgaactagatccttcaattgttgctaaggaattgacaaatttaattgcagaagataaagtgcaacatattggaactaaaatttttagtaatactctattttttgccgaagaaggcatcaaaaaaaacttacaacgaatactaaatcagcctcttgataaacaactaaatcacaaagatattgaccgtgaaatcagagatattcaaaaatctttaaatatccactacgataatatccaagaaaaagctattagagaagctttactaagtaaggtatttatcttgactggtggcccaggaacaggtaaaacaacagttataaatggtattattgaagcctattccgagttacatcatattgatttaaacaaaaatgatattcctattgtacttgctgctcctacaggtcgtgctgctagacgcatgaatgaacttaccggtttaccgagtgctactattcataggcatttgggattaaacggagatagtgactatcaaagtctagatgactatctagattgttccttaattatcattgatgaattttcaatggttgacacttggcttgctaatcaattatttgacgctttggactcgcacacacaagttattattgtcggagatagtgatcaattaccgtctgtaggtccaggacaagttctagcagatcttttaaatataaatgcacttccacacgttaaacttgaaaagatttttagacaatcagaagaatcaactattgtgactttagctaatcaaatgagacagggctttttgccagaggactttacagctaaaaaagccgatcgctcatactttgaagcatctgctaatatcatcccaaatatgatttctaaaattgttcaatctgcacttaagagcggtattgaagctcatgaaattcaaattttagctcctatgtatcgcggccaagcaggtattaataatcttaaccttatcatgcaaaatctcctcaatccattaaaagataataaccaatttacttttaatgatataaatttccgaataggagataaagtgttacatttagtcaacgatacagagcttaatgtttttaatggggatattggttacataacggaccttataccagccaaatatactgagagcaagcaagatgagatttatatgacttttgacggtcaagaagttatctatcaacgcaaagaatggcttaaaataacactagcctatgctatgagtattcataaatcacagggttctgaatttcaagttgttattctgccaataacgagacagagtggtcgaatgttacagcgaaaccttatttatacagctattacgagatctaaaagtaaactaatacttttaggagaaattggtgcatttgatttcgctgttaaaaacgagggggcaaagcgcaatacttatctgatagaaagatttgaaaacaagcaagaaatagctaattctcaaaaaattgaagatagctcaatagatcaaaagattgacaacacaataattaatacgtccattccaaaaacagcaacaccaattgagcagactaatctttcaaaaataacttatcgcctaactgaagaaaattatttaacaatcgatccaatgattggtattaatcaacaagatataagtgcaatttttgatagtaaataaattttttcataaaatcttgaaaactcttccaaatatgttataatatcattgtattaagaacgtagttcaaatttaatacttttattaaggtttatttagaaaaaggagatattatggtttcatatgaaaaagtccgccgctctctgcgcacagctacaatcactatcattgtattaaatagtttgtctttagtattcagattgtttacaggaatttcagtgcagctagccaaaactgaaattaataaagggaacacaggtaatcttcctaaagaacatatcgaagcagtcttgagcgccacaacaccatttatgctatttgtcactgctttaatagtattagtcaacattgccattgttattttctgtattaaaaatttaagagcaattaaaagaaatcaaacggttaattaccttccttattaccttggcttcgccattactgtaggacttgttattttgggttttctaactactaaagcaccatgggcaatagctataaatatcgtcttccaagctattttcggtcttctttatttccatgcttatcaaaaagcacaaaaactcaacgaacgtgatcttgaagagactaactaaaagtaaaagcactagaatctagtgcttttttcttttcaaagagagttaaatatagtcatcgtcccaacttttaaaaatctaaatagatagcttcatgttcattttccagggtcgttactgtaacacctaagagtcgtatgccaaaaactgactcttctaaggtatcaaatatcgctttagcaacttgatcaatgatttgaaaatcttgagtatactcttctaatgtcatacgtttcgtcaatgtttcaaaatccgcatatctaacttttaaaacgattgtcttaccaactttcttatttttctccagagaagcaacaactctctgaacgttctttgaaatctcagctttgatatctgcttcgttatatagtaatttcccataggttttctcacttcctattgatttacgaactctatcaggttttaccggggaagcattaatccctcttgccttacgataaaggtcatacccgaaacgaccaaacatatcaattaaagaaatttcagataaggaaaggaggtcctcaccagtataaacccctaaagcatgtaatttttcgacggagcgtttaccaacaccatgaaatttctctattggtaagggcttcaagaaatcttgagcttgatctggtaggatgagggtaagtccttttggtttctcaaagtcagaagccaattttgccaaaaatttattgtaggaaatacccgctgaacaggtcaaatggacatcattccaaatatcgtattgtatcattttagcaagtttaacagctgattttattcccattttattttcagttacatctaaataagcttcgtctatactcatcggttcaaccaaatccgtatactttttaaatatatctcgtacttccattcctacttggcgatatttttggtaatttcccgaaataaagatagcttgagggcatcgttcatacgcttcttttgaagacatagctgaatgaactccaaactttcgagcctcataattacaagtagaaacaacccctctgccgccggtttttctgggatcagaaccaataataacaggctttcctttaagagagggattgtcacgctcttccacagatgcaaaaaaagcatccatatcaatgtggataattttacgcgacgtatcatttattaaaggaaaaattaacattgttctctcccccattctctctactccattataacagattacaacttaatgatacagattaaaaaaactgtattataaaagaatcataattttgtcaagaaatatgcttgcgaaaacgtttactttttcctaaaatggatatgtaaacaaaattaaatctgtcacaatgtttaaggagaaaactatggcaacagttaaaacaaacacagatatctttgaacaagcttgggaaggctttaaaggtgttgattggaaagaaaaagcaagtattgctcgcttcgttcaagcaaactatgcaccttacgatggagatgaaagcttcttagctggagcaactgaacgttcacttcacatcaaaaaagtgattgaagaaacaaaagctcactatgaagaaactcgcttcccaatggatactcgtgttgcttcaatttctgaattaccagctggttttatcgacaaagataacgagcttatctttggtattcaaaacgacgagcttttcaaattgaacttcatgcctaaaggtggtatccgtatggcggaaactacacttaaagaaaatggttatgaacctgatccagctgttcacgaaatcttcactaagtacgctacaacagtaaatgatggtatcttccgcgcttatacttctaacattcgtcgtgctcgccatgcacacactgttactggtcttccagacgcttattcacgcggacgtatcattggtgtatatgctcgtctagctgtttacggtgctgactacttgatgcaagaaaaagttaatgactggaatgcattgaatgatattgatgaagagtcaattcgtcttcgtgaagaaatcaaccttcaataccaagctcttggtgaagttgtaaaacttggtgacctttacggcgtagatgttcgtaaaccagccatgaacactaaagaagccattcaatgggtgaacattgctttcatggctgtatgtcgtgttatcaatggtgctgcaacatcacttggacgtgttcctattgtccttgatatctttgcagaacgtgacctcgctcgcggtacattcacagaatcagaaatccaagaatttgttgatgattttgtccttaaactccgtactgtaaaatttgctcgtactaaagcttatgatgccctttactcaggtgacccaacctttatcacaacttcaatggcaggtatgggagctgatggacgtcatcgtgttaccaaaatggactatcgtttcttaaatacacttgacaatatcggtaactcaccagaaccaaacttaactgttctttggtcagatcaattaccatatgctttccgtcgctactgtatgtcaatgagtcataaacactcttcaatccaatatgaaggtgtatcaacaatggctaaagaaggctacggtgaaatgtcatgtatttcatgttgtgtatctccacttgatccagaaaacgaagacaaacgtcacaaccttcaatattttggtgctcgtgttaacgttatgaaagcacttcttactggtcttaacggtggttatgatgatgttcataaagattacaaagtatttgacatcgacccaattcgtgacgaagtactcaactttgacactgtaaaagctaactttgaaaaatctcttgactggttgactgatacttatgttgatgcgatgaatatcatccactacatgactgataaatacaactatgaagctgtacaaatggcattcttaccttcacatgtacgtgctaatatgggatttggtatctgtggttttgcaaatactgtcgattcattatctgcgattaaatacgctactgttaaaccaatccgtgacgaagatggttacatctacgactacgaaacagttggtgacttcccacgttatggtgaagatgatgatcgtgttgactcaatcgctgaatggttacttgaagccttccatggacgccttgctaaacacaaactttataaagatgctgaagcaactgtttctcttcttacaatcacatcaaacgttgcttactctaaacaaactggtaactcaccggtacataaaggagtatatctcaatgaagatggtagtgtaaacctttctaaagtagaattcttctcaccaggtgctaacccttctaacaaagctaaaggtggctggttacaaaacttgaattcactttctaaacttgatttcgctcatgcaaatgatggtatttcattgacaactcaagtttctccacgcgctcttggtaaaacatttgatgaacaagttgataacttggtaacagtccttgatggttactttgaaaacggtggtcaacacgttaacttgaatgtcatggaccttaaagatgtctatgacaagattatgaatggtgaagatgttatcgttcgtatctcaggttactgtgtcaatactaaatatctaactcctgagcaaaaaactgagttgacacaacgtgtcttccatgaagtactttcaatggacgatgcattaactaactagtttgtattcgatgaagtaggtttgattatatcaaacctacttttatctatattatcaatagtactaattacttctttatataacctcaaggaggggcctaatgttaaatcacaaatttcttcaagttctaaaatatgagggtgtcgtttcgataacaagctggatcgaattagctcctcacgttacaaacacttggaatagctacctgactattacagatgaccagcgtatattagctcctgcagcaggaatgactcatcttgaaaatgatctcaataataattctaaaattattatgactctgggcagccgtgaagtcgagggtcgtgatggttatcaaggtacaggctttagaattgaaggaactgctaagctattagaagcaggaagcgattttgaaattgttaaagaaaaatacccttttctgcgtaaagtattggaagtaactcccataaatgttatccaacttttataaaaaacttctcctagaaaattctaggagaagttttttattcaaagtacgatgttatcgcctcttgtacatgtcgtcgtttcttaatccaaagtggacggtcatcataggaaaaggttctgtttgtcaaaaaaatagctgctgcctgcttttgataatttagtgcaataaaaggaccagtataaccagtatggtttatccaatccttatctatatcccaagctaatgatcttgatttactcaaactataattattccacaaaggcttcgcaaaatcatcttttaaataatgaatagaaaatctttgtaaatcatcaatagttgaaaataaacctgcagaaccagtatgctttcctaataccttagctttaggatcgtgtacaataccatcgttaataccgactacagttggaacagcttctactctaggaccaaaagaggtttctttcatctgaaaaggagtgaaaatataacgtttgaaaagtttatccaaactatcccctaatacctcttctaacataaaaccaagtaaaagaaaattaatatcagtgtatttaaacgatttatcttccaaaaccttgatatgattaatggcatctttcagctgagtagcattcaactgatcacgatttggaataaaagggtcaattccactgctatgtgtagctaattgccttacagttaacgtctgatgatgaaacgtagggtaataataccttaatggcttatcaatatcaatagtcccttgataaactaactttgctagtaaagttcccacgccgacaacttttgatacactggctagatcatagaccaatcccgctttaactttctcattgccatcaattgtccccaagtaatgttcgtgccactctccattttcataaatagctaagcttgcaccatgataaagattatctttgatttgctccttaatgagttctaaaacagtattagttttaatcattcttttgaaatccaaatctcaatattactagtgtcagagatgactaaaatcttttctttagaatcaaggtaaacatcaagtcccaatgattcaaaagttgatttcaagtcatttaaattagtatcttcattaacacagcattctagtatctcaatatcccaagtttcatttggagcaatttgcaaatcttgtccctgtgcttctttgaaagataaattaattgggaacttcccagcaaatactttatcgtaaaaagcttcagctttcacggcatcaggtacattcaaactaatagattggaaagcaaagtttgatagacctgtagtgtcatcttttttttctaactctgggcgctcaattgccactaattgtgacaaatcatcttcagcatgaagtaagaaaaggtctccctcgggcgaaactgtttcataggcataaccattttgaccttgatatacttgaatggcttgcgcaccatttgccaaaagcttttcaatatcttttgcatcttgagacttaacaataatctttgctaacttcttagtaccattcaccgcacgagtacgataagttggggattcctcaataataaagctagcctctttgttctgccatgctgagaaaactgcgattgcattttcttcacttatcaatttaaatccaagagactcctgataaaatgcaatattcaagtctctattattaacacgtaatactgggtgtttaaatgtcaatgaatgaaataacgtcataaattcctccttgttcagtctagtctattttagataattttagataatttagcaagaatctttgtgctctcaataccataaagtcaaattgacagtttcactatttttttgtagactggatattatgaatgaaacactactattacatgggattcagcttattctgattatcgccatgattatcactttttatcagattgttagacatattaggtctcaaaaaataaatcctttcaaacgatttttcactggtttgtggatcggttttgtaactgatgctctcgatactcttggtatcggctcttttgcaacaacgaccacattttttaaactaactaagcttgttgaagacgatcgtaagatacccgcaacaatgacagctgcacacgtacttccagttttgttgcagtcactctgttttatttttgttgtaaaagtagaggctttaacactaataacaatggctggtgcagcttttattggggcttttgttggagctaaaatgactaaaaattggcacgctcctactgttcaacgtattctaggaacactgctcatcacagctgctattattatgctctatcgtatgatcactaaccctggcgctggtatttcagattcagtgcatggtctacacggcatttggttatttgttggtatcggcttcaattttattattggtgtattaatgactatgggactaggtaattatgctcccgaacttatcttcttctccctaatgggactgagtcctgcagttgctatgcctgtcatgatgctagatgcagctatgataatgacagcttctagtacacaatttatcaagagtggtcgtgttaattggaacggctttgccggtctggttactgggggaatattaggcgttattgtcgctgttctcttcttaactaaccttgatcttaacagcttgaaaacactggttgtaggtattgttttatttactggagcaatgttaatacgttcttcctttaaaaaaactatgcccaaaagtcatcattaaacgaaatcagctagcaagactggctgatttttatatttaaaacaaaaaaagaccggtaaaccgatctttctttaactattaaagatataatagtttgaacaaggctacagcgagtatacttgctacgattggtgctaaaactggcacccatgcataccaccattttgaatcttctttagcttgtccaagaatttgttttggtaataagcggtgaacaatacgtggaccaaggtcacgcgcagggttcaatgcaggtccagtcggtccacctaaagaagcaactagagtcattaccaagaaaccaatacctaagtgagctacagcaagtgaaccagttacgtatggtgaaatccttgtcgctgctgtcgtttggtcataaccagcttgaacaagtttaccaacaagttctacaccaaaatagttcttcgttaaagccaaagctccaaagaaaagaacaaaagaaccaacgaattcatttaagaaaccattaatgtaagccgctttacgacttgatttctgtccatcatctaatgcagaaatagttgaaaatgatccaagaacatgatttggattttctgtcttaacaaagtaaggttgataaaccataacgacaactaactgtccaaacattgctcctaaaatttgtgcaagaatgtattgtccaacgtgtgcccaagggaaaagacctgaaaatgccaatccaagtgtgaaagctgggttaatatggtttccagagacattaccaaacataagcgctggcatcataacacctaaaccataaccaattgcaataataatccaacctgaattatttccttttgtgccttttaagtcaacgttagctacagccccatttcctaagatgataagaaaagcggttgcgataaattctgtgatatacttcacagtccaagtgatttcgatcaatccttgtttcctcccaaaaaaatatttacaacattaaccattctaccaagtaagcttaatattgtaaagcttatcacaaaataaaattaataaaatttttaaccaaatatatttgataaaaaatagagtactaggttcggactacctagtactctattttatttagtttataaggttttcttactatcacgaacgactagcatatcaactttcgaatgacgtaaaatgtattctgaagttgagccgatcaatagtctttcaaaagtgtttaatcctgttgcgcctaccataattaaatctgctttttcccttatggggatatcctttgccaaaagagtcttaggatttccgatttcagtaatttttttaatctttgtaaggccttttgaatgtgctaatttctcaaaataggctagcacatctgctgactcttgttcttgcctatcaaaaacatagtcactaaagactccctcactttggtaagcgtgagcatctataacatgcgttagcagtaattcagcatcattacgaagagcaacatttatccctttttctaccgccaattctgactcgtaagacccatcaatagcaataagaatacgctcatatttttgtgtcatagcttaattcctcccttttatatagttttagtttcaacttgtctagatgattttaagaaatatagaataccacaaacaacaggaataatcgctgctatccagaataattctctaaaggattgcacaccagctccaagaaaaccatctttaacaagtcccaaaatgtaaggtccagcacctaaccctaaatcaagacctatcatgtaagttgacatggctgtattgaaacgatgttcctcaacacctttgattgatgctgcttggccacaagacataaaggtgccataaccaaaaccaatcaaagcacctgatagaaggtaggtaacacttcccatagcactccctaataaagcaagtcccaaagttaagaacagataacttggataaagcacccacttatctcccttagcgtccattaatcttcccatagatggtctggttaaagtgatgacaagtgcataaacaataaagaaataagctcctactgtcatcaaattaatttctgttgtatataatttttggaaacctaacacggaagcataggagatacccatcaaaaatgcaataattgtgataaaaattgcttttttctcaatgaaactatcaatagtccatgattttgatttagctaactgttctggatttaaagtaatatttttgactgggaaaacaaatgctcccaacactacaatcgcaattaaaatactacataatacaataaccattttaaagttaatatgaaggttgtctagcataaatgttcctacaaaaggaccaatagctgcggctaaacttgttgatagaccgtaaaagttaatcccctcacctcttttatcagctggtatataggctgttacaatagtattagttgctgttgacacgacgccataaccaaaaccatttaggaaacgaactaaatacattactccgatacttggcatataaaaataagctaaagttgttagtaagtaaaaaatagcccctccacgtaaaactaacttacgtcctagaacttctaattgcttgccaaatataagacgagcaatcaaagtccctacaatataaatccccgttgctaatcctgcttggctagtgctaacacctaactctttagtcgcaataaaagctatgataacggtaaacaaataatagaccatataaacaataaagtttaaaatagtaatgcctataaaatgtttgttgaataatttgtcttccaatgcaaatggctcctttttttcaatttcattttcataaacattttacaaaaatattagaagatacgatatttcaatggtataatataagtgctagtatcagactgcattaacaaatgttaaggtggtctatcaaacctaaaacatttggaggaagtcatgaatcatcaaattttacaaaattacattaatagtcataatcttccaattatcgaaaaagactaccataaataccttacatttgaaagtttagaagaagactatacttatatcctaaaagatggtattgttaaacaaagtgttctctctaaatatggtactgagttcaatctgcgttatgtgacaggcttagaaatcacttctatcctaaatacagactactcccaacacatgggagaaccttacaacgttcgaatcgaatccgaaactgcccacttttacaaagtacgtcgctctaccttcctaaaagatatcaataatgatattgaactgcaaggatatgtgaaagatttctatcataaccgccttgaaaaatctatgaaaaaaatgcaatgtatgctcactaatggtcgaattggtgctatctccacacaattatatgacctcagtaagatgtttggtgaagaacgagataacggtgatatctatattaattttgttatcacgaacgaagaacttggtaaattttgcggaatatccacaggaagtagcgtgagccgcattttgaaacaactaaaagacgatcatattattcgtattgaaaaacaacatatcattattacaaatgttgagaaattaaaagatcatattgtattttaatataacaatagaaaggatatattatgcgttataatcaattcagctacattccaactaaacctaacgaagcttttgaagagctcaaaggactaggttttccattaaacaaaaagaattctgataaagctaatttggaagcttttctcagacattcttttttaaatcaaactgatactgattacgctcttagtctccttatcgttgatgcaaaaaccgatgctctaaccttttttaaatcaaatagtgacttaacactagaaaatttacaatggatttatttacagttattaggctttatcccttttgtagactttaaagaccctaaagcattcttacaagatattaacttcccagtctcatatgacaatatttttcaaagtctacatcacttactcgcctgtcgtggaaaatctggcaatacattaatcgaccaattagttgctgatggtttacttcatgcagataatcactaccattttttcaatgggaagtctctggccactttcaatactaaccaattgattcgcgaagttgtctatgttgaaacatccttagatactatgtctagtggtgaacatgatttagtaaaagttaacattatcagacccactaccgagcatactatccctacgatgatgacagctagcccctatcatcaaggtatcaatgatcctgccgcagaccaaaaaacataccaaatggagggtgcgctagcagttaaacaacctaaacacatacaagttgacacaaaaccatttaaagaagaagtaaaacatccttcaaaattacccatcagccctgcaactgaaagcttcacacacattgacagttatagtctcaatgactattttctttctcggggttttgctaatatatacgtttcaggtgtgggtactgctggctctacgggtttcatgaccagtggggattaccaacaaatacaaagctttaaagcagtcattgattggttaaatggtaaggttactgcattcacaagtcataaacgagataaacaagtcaaggctaattggtcaaatggccttgtagcaaccacaggtaaatcttatcttggtaccatgtcaactggtttagcaacaactggcgttgaggggctgaaagtcattatcgctgaagccgcaatctccacatggtatgattattatcgagaaaatgggcttgtgtgtagtccaggcggctaccccggtgaagatttagacgttttaacagaattaacatactcacgaaacctcttagctggtgattacatcaaaaacaacgattgctatcaagcattgttaaatgaacaatcaaaagcaattgaccgtcaaagtggggattacaaccaatactggcatgaccgtaattacctaactcacgtcaataatgtcaaaagtcgagtagtttacactcatggactacaggattggaatgttaagccaagacatgtctataaagttttcaatgcattgcctcaaaccatcaaaaaacacctttttttacatcaaggtcaacatgtgtatatgcataattggcagtcgattgattttcgtgaaagcatgaatgccttactaagccaagaactacttggcattgacaatcatttccaattagaagaggtcatttggcaagataatactactgagcaaacttggcaagttttagatgctttcggaggaaaccatcaagagcaaattggtttaggtgatagtaaaaaacttattgataaccattatgacaaagaagcctttgatacttattgtaaagacttcaatgtgttcaaaaatgatcttttcaagggaaataataaaaccaatcaaatcactattaatcttcctctaaagaaaaattatctcctgaatggacagtgcaaactccatctacgtgttaaaactagtgacaaaaaggccattttatcagcccaaatcttagactatggtcctaaaaaacgattcaaagatacaccaaccatcaaattcttaaacagccttgataatggtaaaaattttgccagagaagctttacgtgaactcccgtttactaaagatcattatcgtgtcatcagtaaaggtgtcttgaaccttcaaaatcgtacagacttacttacaattgaggctatcgagccagaacaatggtttgatatcgagtttagcctccaaccaagtatatatcaattgagtaaaggtgataatctaaggattatcctttatacaactgattttgaacataccattcgagataatgctagttactctataacagtagatttaagtcaatcttatttaactatcccaactaatcaaggaaattaacttatgaaacttctcactaaagaacggtttgatgattctcaacacttttggtaccagatcaatttattacaagagagtaacttcggagcagtttttgaccatgataataaaaacattccacaggttgttgcaactattgttgatgatttacaaggttccggaagttcgaattatttctggtattttggcaatactactgatacttccatccttatgattgctcatttaaatcgaaaattctatattcaggttaatttaaaggactttgactttgcactcaatttaatagctataaataattggaagagtctcctccaaactcaactcgaagctctaaacgataccctagcaatatttcaataaataaggtagaatggagtgacaaagcaacgcgagggagactgattaatgtcatcttattggaataactatcctgaacttaaaaaaaatattgatgaaaccaatcaactaattcaagaaagaatacaggtcagaaataaagatattgaagcggcgctaagccaactcacagctgcgggaggaaaacagctcagaccagcattcttttaccttttttctcaacttggtaataaggagaatcaagatactcagcaactaaagaaaatcgctgcttctttagaaatccttcacgttgctacattaatccatgatgatgtcattgatgactcaccactaagacgtggaaatatgaccattcaaagcaagtttggcaaagacatcgcagtttacactggggatttacttttcacagtctttttcgatcttattttagaatctatggctgatacaccatttatgaggattaatgcaaaatctatgcgtaaaattctcatgggagaattggaccagatgcaccttcgttacaatcaacaacaaggtatccatcactatttacgtgcgatttcaggtaagacagccgaactctttaaattagctagcaaagaaggagcttactttggtggtgcagagaaggaggttgttcgtctagcaggccatatcggctttaacattggtatgacattccaaattttggatgatatcctggattatactgcagataaaaaaacatttaacaagcctgtcttagaggatttagcacaaggcatttacagccttcctctacttcttgccattgaagaaaatcctgatattttcaaacctattttagataaaaaaacagatatggctactgaagacatggaaaaaattgcttatctcgtcgtttcccatagaggtgttgacaaagctcgccatctagctcgtaaatttactgaaaaagctattagtgacataaataagctaccccagagctctgcaaaaaaacagttgctacaattaactaattaccttttaaaacgcaaaatttaaataataaaaaaacattccacaatgctagaaaagcagttagggaatgtttttttattatcatttatttatcgcacctatcaatcatcatagatcaccatcatcagaggctttcagctgacggtaacgttggctactttgagacaattcttgaggagaaccttccaactctaattgcccattttctataaataagatacgatcagcatgttcaataccttttaagtgatgtgtaatccaaactaaggtcttaccttccaattctttcataaatacccttagtaaggcttgttcagtaataggatcaagtccaacagttggctcatctaagataacaattgggacatcttttagtaagattctagccaaagcaattctatgcctttcgccacctgaaaacctaagtccagcttcatcaaccattgtatagagaccatctgataaatcagtgaccatctctttcaatccaactcgttcaagaactttccatacatcttcttcactagcatcttggtttccaatgcgaatgttatttagcagggttgtattaaaaaggtagggcgcttgttgtatcactccaatatagttagaaatgcaatcaccaactattgaaacatcagcatcgcctagggtaatctccccttgacttgctttcaagtcgccacgaagtagactggctaaggtactcttgccagaaccactacgccctaaaatagcaattttttctccttctttaatatccaaatctaaatgatgcaaaacccatttctcttgtggcttatactggaaacttaaattcttgacggaaaaatcgtatggcttattaggcaactgattttgagttgtttcaaaatacgtttctgataattcattaagacgatgaattgaatcagaatatttatttgtttcttgagcagcagcagacaaaccagcaaatgcctctgacaagggaaatactgttagaacaaatgctgcaatccagttagcttcgccacctctgtgaccaataaactgattactagcccaaataataaccaaaatagctagaaagccaaaaactaattccacaataagagctctacgattatcaaaggaacgaatttttttctgaacagccatgagttcactttccgaacgctcatgcaaggcgacgtactcttgaccacgttgactaaaaatccagtctgaaatacctaagacattatccgtcaaatcagtataaagatgattttttaattctttttcacgagtctgacgagcaccattagctaaaatcgaccaaagtggaaaaagaaaaatcataatagctaaataaagcaacatcattaaagcaaaccatagagaaaagaagcctgttgcaataataataaagctatataatatccacgctataatcgttggaaatattgtcctaagatacaaattttgcaaataattaatatcctccgctaaaagccccataacatctcctaaacgaaaatcacgcttcataaagatagcattgctttctaaggaatggtaaagcttcaagcgcagctgtgaagtcattcgtaatacccaattgtgactcgttaggcgttctatataacgaaaaacaggacgtccaatgccaaaagcacgtgttagtacaattggaacatatactagaagaatattactcggtagtgaagctgacttactaatcagatagcccgaattaaacataagagcactggcagaaaagaaagtcataaaaccaaggaaaagagcaattactaaggaaactttatattgtttgaaaaatggttttatccattgatctgtctttaattctttaaacaaagggattttaaacatcatttcctcccatagcatgcttcagttgatagagatatccttttttagctaataattcctgataagagcctacttctgcaactctccccttctccataacgactataacatccatttggttcaaccagtgaagacgatgagttgcaaagataactaaacgatctgacatcagtggcaacattttctcttttaattctaactctgtttcaatatctaaatgagcagttggttcatcaaaaaccataatacgacgattttgatcaagaaaagcacgagccagagctatacgctgggcttgtcctccactaagcggacgcgctccattaccaatacgcgtttctaaaccgtcaggtaactcgcttagcaagctatctaaacctaccatatgaatcgctcttaccacctcttcgtcactagcattgggagtatagaaggtaatattatcacgtaatgacatttcaaaaacataaggagtttgaggaatatagatcatctgtttatgccaatcttcttgatcaaggttagtcacttctctaccatccacttttaaagaaccattatcaggccctaaaaaaccactcagaaggttaattaagctagacttacctgaaccactaactcctactaaagcaaccttttgatgtcctctaaatcgtaaggttacatcctcaacaacacgtttttggtcgtacgcaatagcaatgttttctaaatccaaacgactctctttagaccaatcatctatgactaattgctcacctttaataccagttttgtttagaactttttgaatcgcttgaaatgcatttttcccgtctaacgttgcatgataatcactagaaaaatctcttacgggtaaaaagtattcaggggataaaatcaaaattgttaaagccggtaaaaggtaaatctgctcatttaataatcgtaaacctagaaaaacagcaacgatagcaatggataaagttgtaaaaaagtctaaagcaaacgttgataaaataccaattttcaaagtactcattgttgctttacgaaaagattcactagtttgataaatgcttttaccataacgtttactaagaccaaaatatttgagagtatcaatgcctcgtaatgaatctaaaaaatgattagaaagtacttgataggattcatattgtttatctgctttagcttgagccgcatagcctaaaataatcataaagatgataattaaaggaaaaacgataagtaaaattgcacctgattcaatatctaaatagaaaatataagctagaataatccatgggataatagacatgttaatcatcttattcaagactaaacgtaaataattttcaactaaagaaacgccatctaatgccattgtaacaacattaccagttccttgttcttgaacgactttaggacctagatcaaataacttatctaataattgacgtctcaaaagactagattgtgctgttgaaaagtcatcaagttttctatttttgatgtaatcaataacatgacggcctaaatatgagaccataaataacaaaatataaaccgtttgagaagaaagtttttgcccttcccacaaaccagttatagaaagactcaaataataagcttgtccgataataaagattgcttgaagaacatcaagtcccgcaagcaatcctaacaacttatgaatacctgacaagcgcataaccgctttatctagcattatttttctcctgtcacaatcactggcaaggtaatacgttttctaaagatataatatgcccatgctgtataagctagaacaaagggaactagagtaattgcgacaatcgacattacttttaaagtatatggcgttgaggatgcattttgaatcagcaaatcatatttagggctaattgatgaaatcataactcgtgggaatagaccttggaacaacagaacaaccactgaaacaagactgagaccactcgctaaaaatgctgtcatctctgctcctttaaaagttgaagcatgcgctaatacagctaatacaacaataaccaaaaccataattgtcgtaactatcggatgattgctaaagaaatctgtcttgaaatacaagagaactgcaaacaaggctaaaccaagatagagtacccaataaagcaactgagcataattacgggcacgctctctaattggcccttctgtcttcaatgcaatgtagtttaaaccatgaagataggctagcaataccattgcaactccacccaccaacgagaatatattaaagtaatcactgaattgagctgataagttaccactggcatcaagtggcataccttgaatcaaacttataaacataatcccaaagaagaatggaacaatagcggaaccaattgttaaggtccagttccaaaactgctttttctctgcaggaactttatgtctaaattcgaaggaaacaccacgaataattaatccaaagagaatcgtaaggagaatcaaatagtaaccactaaatagtgaagcataccagtatggaaaagaagcaaacattgctccaccaccggtaagaagccaaacttcattaccatcccaaactgggccaatggtttctactacttgatctttttcatgctcattatgtgttaaagtttgaacagccatcccaaccccaaagtcgaatccttcaaggaagaagaatcctgaaaataggaggccgattaggaaaaaccaaaagaattgtaaagcactcatttagtatgctccttcctcaaagggatcaattgaagtatatgcaccatgatgtccgtgttcatcttcatactctggccctttcttcaattctcttattgttaggcttatcatcatcaccgctaaaccaccaaacaacaagaaatacacagtattggaaacaaataatgatgcaactgaaacgtttggagagacagagtccttaatcttgaaaagaccatagacagtccaagggtatcgtccttgttctgtcacaatccaaccaaatgtattggctaagaatggtgcaaaggttgttaaagcaacaatccaaagcatccatttgtgtttataaagaattggttttttcttacgagttaaaaagagtcctaaaacagaaacacccataatagctgttcccatcgccgccattgtacggaaaccatagaaaagtaggttaaccattggatagtagttatctttaccatacttagcaaccaattctttattagctgtatccatacctttcacagaaccagatggtttcccgtaagataaaatactcaacatataaggaatcttaatcccaaaaacttgtttgtgttctgcttcatttgcccaagcaactacactccaagctgcaggatcacccgaatcttcataatcaccttccatagcagcaaatttcattggttgatcgtgaatcaaggctttcatttgtaaatccccaactcccataactgaaattgaaccaagaagtgctactactaaaccaatacgaaccgatttcttataaagttcaaccgttgtatctttcagctgttctgattttaagaggcggaaggctgacataccagcaaccactgtaccacccatcgtaatggcaccaaaaataacatgggtaaattcatagaagaactgtggattttttacaagtgcaagaaaatcagtcatttgcgctctaccgtttacaacttcataaccaacaggatgttgcatgaagctattagcagtaagaatccacatcgctgacattaatgagccaaaaaccactagccaaatgaatgtcacatgtaattttttactaatttttttgttatcccatgtaaacatccataaaccaaggaaagtagattccataaagaaagctaataaagcttcaatagccaatggagctccaaaaatatcacctacgaaacgtgaatagtctgaccagttcattccaaattggaactcttgaatgatacctgtcacaacaccaaccgcaaaactaaggagcatgatattaccccaaaattttgtcaattttttatactcttcattttttgtgataacatacattgtctccataatagcaaccactaggcatgtaccaattgtaaatggtacaaagaaaaagtggaaaactgtagtcatcgcaaattgaaaacgagctaaagtttcaattgtcatacaaaacctcttattttgttttaatcatttcttttatagaaatatctgcaagagctagtttcctagcttcgtaacaattggtaaataacttactttaatatcttaatgatataaatcaaaacgtcccttagctagaagttctttaagtccacccatatcaacaagtgatttgttcatgataatcttcttcataaccgacgcagggtattttttaattttagtttttccaacaacaccaagtccatgcgtatttcctactgaagcaactgtgccttgcggactatacgaaaagtcttctgtagcttcacctttgatttgatgtaaaaggtttttagcaacatgagctcccatacgagttgcaatttgagctgttgttgggaatgggcgaccagactcagtgtccataaatgcagacacatcaccgataacataaacattatcgtattttggatcacgcaaatcactgttgaccattacacgtccacgacgttgatcaaatcctgattctcccataaccggacttccactaacacctgttgtccaaatgatagtacctgcggtaatagatttgagttcttcatcctctttactagtaccataaacaacttcacccggtttgatttccttaatcatacttccaagcatcaaattaatacctaaatccttaattaagttgacaccatattgcgctaattcatcatcaaacattggtaggatgcgagttgctgcctctacacaaataatttcaatttgttcaggttttacacccgctaaagcagcatattttggtcgctcatcaaccatagctccggctaactcaatacctgtaaaaccagcaccacatactaagagtttgagaagattttcatcttttgtctcacggtacaacttcattgtattaacaatgtgattatggatgttttctgcttgcgaaatattggtcatctgcaaagcattctccatagcacccttgatgccaaaagtttcagatacaaagcctaaggcaactacgacataatcataatggagttcaccgttatttttaactgttactgttttattttcagcatcgactctaagcacctcatcttgcatgaagttaaccttattagtgttgataacatccttaattgggaatgtaattttttcttttggctgagagcctgcagctacttcatgtaattctgtagcttcgtagtgataatcattcatgtcaacaagggtaatatgaaaatcacctgattgtttttgtaaattacgaactgctttcaaaccggcataaccagcacctaaaactaggatttctttcatgataaaactcctctaaaaaatgattccaattagatacgttaagacttgggttgcagatcccagtgctagaatacgtaccgcacaaacaaatgtttctctcttaacctgtttttgccacaatagttttgtctgcttataaataaatggtattaataacaaactcaagagtactgtaacaggcgcaagtccaaaaagaaattcaaaaacaattgccaataaagctatactattagaaatagcaaacagcaagagtccacctcttatccctgtataatgtacaagggtatagcgatgatttttttcatcttcttctttgtcgcacagattattcgccaacattagattggcaatccataaggtgttcggcaaggaaatcaagaaaattttgcttaagttgaggatatcccacgaaaagttttgataagtgtttagatatacacaaattaaactaatcataaatcccattgtcaagccagaaaatacttctcctaagggcagactagataaaggtcttggaccaaaggaatataaaacaccaattccaaaacaaaaaagtcccatccataaaagaggcagaccaacttgggaaactaaaactaaaccaatcatactagaagtaatgactaaacttgccataataacttctatttggcgtagggataggttctcacgaccaataatgttagtgtcattcttataatccaaatccacagcattccgataatcattgtaattattccaaatgtcaacgaacatattgaataaaaacatagcaacgaagaataaaccgacatatacagggtgtactgaattgtagtaataagcactaaaacacaaaccaatcaaaaatggtaaaacactagctgttttggctttcatttctaccaactctagaaagattggtaatgtcattattaaagtcctctctatacataatcttcaacaatactattataatgcaatttctaccatttttaaaacaatagggcttgatttttgattaaaaatacaaaaaatttttcttaaaatgagttaatcacacttagaacactaaatactattttgaggagtcctattcatcacactatgccatgtaatattcggaaaaatagtattgcaaccctcaactatcccttatgttggcaccagcctttgaaagtcctctgattgcactgcttagttagtattttcatcagctgtatgatctctaagagccatcagcatactaaaaaaactagtattacactttgaaaagtgtaacactagctccaatttgttttaaatagcttaactatttaatcattaatctactttatatatttaagcatttaaagttgaatgttggttgaggatacctgagagagaaccttgaatataatttggcaatacttgtttttgagcacgttcatagatttctgaatctgttaactgacgttctgatttggggcttgatacttgcggtgtcactgctgcattttgttgtttgtaaagtgttgaatgctggttaaggatacctgagagagaaccttggatatatcttggcaatacttgtttttgggcacgttcataaagttctgaatccgttaactgacgttctgcttttggaggtgttgcttgcggtgctgtgaaagttgaagctgaaacaccttgtgtagaaccaagagctacgaatgctcctccagcaaacattgctgagacaagaccaagtttcaaatagttagcagttgagacgttgttgacttttttttctgtaataagtttgttcataagaattacctctttcttttgggttatttattttatgaactaagtataacaacaagaaataaagtaaggttaaactaaatataaaataattcttaagtcattcttaggaaaccataaaatcatacactaacaaaaaatttggtatctagctcaaaagtaaaagtagaataaaggcttttacttctgagctagtaatgaataaattatatttgcatctagtttggaattagccctagtgtattataatgatccctacaaatatgtgccaaacaccttcttcatatatacaagattgatttaacattcctatacccttaatggtgggcacattctcttcatgttccatatagaaatcaacagataattccgtattgtccctattattaaattttccagttaatgataaattatatcatccaccttgaggtgtcctattaccaatctgttcaacctttacacttgacgaatcgaattgaacagattctgtcttatcattctgtgatttagaacatcaacaatttcttgttcatgttctttgaggtaagctagttgttcttctttaacgtgcttttatctttcgtacttactgatacttgagagcatttttttgaccctacttcttactaatcagctgacgtccctataagatgaatcataaacacatagctgccactaaccattttaaccttttatgcatacataattcttcttgatatcccataccattatctttagtataaacacttaataaaacaagcatttaacaactaaggttaataaaattcaataaatctaatccttctacttactttagtttatcacttttttctctcatcctatgctataatagtaaggtatcaaaatttaggagaatatagtcttatgatgaatatgcaaaatatgatgcgtcaagcacaaaagcttcaaaaacaaatggaacaaaagcaagctgatttagcagctagccagtttactggaaaatctgctcaagagctcgttaccgtgacatttacaggcgataaaaagctaatttcaattgattacaaagaagctgtggtagaccctgaagatattgaaacactacaagacatgacaactcaagctatcaatgacgctttaagccaagttgacgatgctacaaaaaaaattatgggagcatttgcgggtaaaatgccattctaaaaaataaatcacatttactgaatcacctgtaaatgtgatttttatttcaaacttctttcattttttcacgaaaacaagttttattttcaaaaaatatttgcaaaaaatcagcagagaggtataataacattgaaaatattagagagaaggtgactaaccatggttatggatagtctaatcataaaacagttgattaagagtacatttgatatacccttacaagtcacttatccaaatgggaatattgaaacttataatggtagcaatccccacgtcaaacttaaactaaacaaaaatttctccgtctcggagctatcaaaagacccttccatagtattgggtgaagctgttatggatggagacattgaaatttatggttctatacaagaattaattttatcagcttaccgctgtggagacagctttctacgtaatagtaaatttagcaaattgattcctaaacaatttcatgataaaaaacacagtaaatccgacattcaaaagcattatgacatcggaaatgatttctataaactgtggcttgatgataccatgacttattcatgcgcctattttaaacatgaaaatgatagtctagagcaagctcaactaaacaaagtacaccatattcttaataaattaaatgctcagccgggagggaaattactagacatcggttgtggctgggggacacttatcattactgctgctaaagaatatggcttaaatgcgacaggtatcaccttaagtgaagagcaggcttctttcattactaagcgtatcaaggaagaagggttggaaaataaagtaacagtcctcattaaagattatcgtgacattcgtgaaacatacgattatatcactagtgttggtatgtttgaacatgtaggaaaagaaaatttatctcaatacttccaaaccatttctaaaagactcaacatcaatggtctagctcttattcatggtattactggacaagtgggtggtaatcatggtagtggaactaattcttggattaataagtatatcttcccaggaggatatatccctcgtttaactgaaaatttaaatcatatagctagtgctggacttcaaattgctgacttagaaccgcttcgtcgtcactatcaaaagactctcgaattatggacaaaaaatttccacaatgcccttcctgaagttcagaaaactcatgataagcgttttatcaatatgtgggacctctatcttcaatcttgtgcggcctcttttgaatctggcaatattgatatttttcaatacttgctttcaaaaggtgtttcaaaagacactatgcctatgacacgcgattatatgtattctgctaattgatatagttaatattatagtattccaacttattctaaataaaaaggactctcttgaattcaagggagttctttaacgttcttctctggctaactctatacaatgtgacttttggtgacaatgtggacagaatacttttcgcgtcttaggggtatgtttcgctagattaaatgcttgatatgtcggtgtaaaggtttgatgacaatttggacaaagataaacaacctgttgtttaaaataccaaaccataccattcatagctattaagaatactgttactgctatccacataagccatctttgatttagagaaactgctgctattattaacgtaatatagaccataataatcataacgacttgtagcactatgcttttttgtagtataccccattttcttttgttttcttccataagcacaatgtcagaaagatagcctaatgttttactatcttgtttttctacagtttttagtaggttgacagctttgtcaagtttgtcttttttactatcaatagctagccttaattctcttatctgcacttgtaaaaaaagctctaaaatctggctagcattgtcttcagtaaatagatttttgatattatcaattgaaaaatctaaatctcgtaaataaataatttgtctaagcttttctaaatcagcaatactataaaccctcctacctccttcagatagttctgatggggataaaattcctcttttgtcatagtactgaacagtacgaacagtaactcctgcttctttagctaagtcaccagtggaatatttttctgacatgtttcacacctcctttaatatagtaaacacttctttatcagaaacacctttactatatcaaatgacctaaggtaataagcaagtaataacgctaagtatttttaactttaaataaaactacaacaattaatcaaacaaatttcctaaagtcgcaaatgggctatcaactgctacctctttttgctgttttaaatagattttattttcatccaagtccagaaatttttcataaacacgcgcagtcatacgggcatcctctaagctattatgtgctttaccctttattcctaaaaagtcagcaacagtagtcaatttaaggttgacaataccatttaaatctgtactgcgtctcacaaaagcttcatcatataagtccacctgatattgactagttagatccaaaccattttcaactaaaaggggtaaatccgatttatacccattataaccaatcagtggtgtatctccaacaaaactctgaaagtctgtcaaaactatctcaattttaggagcccctataatatctctagctgtaatacctgttaaaccattaataaagctttgtaatggaacttttgtgtgaacataagtatcaaataaagcaatctcttgatgattagaatatttaacggccgacacttgaataatatggctatgctcaccaaccgtgttaaactctaaatcaaaagctatatattcttgtaattgtttcattatttctcctaaaaagcgcaaggaaactccttacgcttttattctattttttattgaagaaacgtccaaagaaactttttttaacagcttctaattcttgaattttttcttctttggcttcttgaatctcctcaacctctgctttagcttcatttaactcaagttgcagacgttgcgtatcttccatagcagttaaagtcaattgctgttgttgatctaattgcttatctttctctgctatttgaatatcttttacatgtaactgctcgtcttttgaagcaatctgaatatcttttgcttttaactgttcatataaacgtgtgatttcagtattcttctcatcaacgagaatttctaaaagttctcgtcttgatgcttcttcgtcaattggttcctcttccaaaatagtttttttatagatttcttccaatttaatcaagccatcacgattaacaactgtaacgcctttactattcttttccacacattcttcagggagtgttttaactctgttattcatcgcttgacgactaacccctaaaatttcagctaattcactaaccgtcttttcaactgtcataacttcctcttttgtactgattttcttataaaagaatatcacaatcctaatctagtgtcaatttactgtcaacttaaagtgtcaaacaagacattttgacgtctatttctctatttatatgctagaataagattatgaagcattatgacacaataattataggtggtggacctgctggaatgatggcagctatttcctcaaatttttacggcaacaaaacacttcttattgagaaaaataaacgtttaggcaaaaaactagctggaacaggtggtggccgctgtaatgttaccaataatggaaaccttgatgagctcttagctggtatacctggaaatggccgtttcctatatagcgtcttctcacaatttgataaccatgatattattaacttctttcaagacaacggcgtcacactaaaagaagaagatcatgggcgtatgttccctactactgataaatctcgtactatcattaacgcccttgaaaataaaataaaagaacttggtggtcaaattatgactgacacagaagttgtctctgtcaaaaagataggagattcattctatatcaaaactaaagatacacagttcgcatccgataaacttatcgtaacaactggtggtaaatcctatccgtctacaggttctactggtttcggtcatgacattgctcgtcactttaaattagaagtcacagatatggaagccgccgaaagccctcttttaactgattttccccataaaaaactacaaggtatctccttagatgatgtcactttgtcatttgaaaagcatattattacacacgatcttctctttactcattttggattatcaggaccagcagccttgcgaatttctagctttgtcaaaggcggagaaactatatacctagatgttttgcccaatatctctgttaaagaattggaaatacacttccaaaatgaaagagaaaaatctttgaaaaacgctcttaaaatacttcttcctgagcgtttagctgaattttacgctgaagacttacccgaaaaagtaaaacaagtatctgtaaaagacttagaaatgttaattcaaaaacttaaaaaacttcctattttagtaactggcaagatgtctctagcaaaatcctttgtaacaaaagggggagttgatcttaaagaaataaaccccaaaacacttgaaagtaaaaaggtagctggtttacattttgctggtgaagtcctagacatcaatgctcatacgggagggtttaacattacttctgccttatgtacaggctgggtagctggtagcttacactattaatacatgaaagctgaacaattccgtcagcttttttatatagaatttaaagataatatttggctcttaaggcttctttgattttttccaattcatctggtaaatttacctgatgaatagcatacccaatctgataaggggatactataaaacgaggaacaattttacaaataagacccccatcatgcttatagaaaaagagattataagatttacagcgccctcccaagaattcatttaaaatataatgacacaaaattggtaaactatctgcaatcaaaatagcgttttccaatttggatactttaattgtgaactctgtgaaatcaagcataggacgattggcaatactaatctctgcttgttgactcgtttccgaacaaacctcgataccatcaaaccaatctaagttcaacgtttcataagcatctacgttttttaagccaacaatttggctatgaggatgtcgtaaacttccgccagataagggcccaaaatttcgataaagaacgaccgaacggtaatgaccactttcttccattaattgccattttgacaaaagataatctaacaattggcgcatctttgactcactataaactgaaatatccccattgtgatcatttgattcaatcaccaatgtttgataggtttcttctaaagttgggtatttattttctacccagatcatatcgtctttcacgtctaggatttttcctaattggcttttatcacaaaatggacatttgtctttattgctgggtttttgtttcgcgatattagggttaaatcggatatatctttcattcatactgttattgtaacacattcatcaccattacaatataatacttatccagttaacattttccttgcattcttagctgaaaagagtataatagaatcatgtcttgtttactggttaattaccagtaaactaggtaccctgttttgggatagaaaaatctttttgggaaaggagaaatcatggctaagaaatcaaaaattgctaaatttcaaaaacagcaaaaactcgtagaacaatatgctgaactacgtcgtgagttaaaagaaaagggtgattacgaagcacttcgtaaacttcctaaagattctaaccctaaccgacttaaaaatcgtgatttaatcgatggccgtcctcacgcttacatgcgtaaattcggtatgagtcgtattaacttccgtaacctagcttacaaaggccaaattcctggcattaaaaaagcaagctggtaattcgtgaagacaaatagttactttttatgactattctattgagtgtggacgaatagttaatacattgtaattatttaacctgttgagtatttactcagctattacaaacttcttcaaaattttattatcataggaatgtaggatctcatcaatccttaaatgactaataataaaagatgaaaaaatttttcttatctcaaatcatagatgccaatttatttattttcaaaaagcccggtatgccaagataccgagctttttattattataaatactgataaaattcttttagttaatcccaaaaacaagactattattttgtaatagtcactactgaataatatttcttttattaaaaactcacaagacatttcttaaagcagttacatcttcgcgactagttgaccaactagttgctagacgtattacagtatgatggtcatcatatttttcccaaaaactataagctacattctttgctaaatctgctagttttgtattttctacaataataaattgttgattagttggtgattttaaatagaatgagtaacctttttcttctaaaatgatttttaattcctctgctaagtcgatcgcatgctttccaatttttaagtaaaggttatccgtaaagaaacgatcaaaagcaagccccagcaatcttcccttggctaataacgcaccatgctgctttacaattgtagtaaactgttttggacgatttttctttgtgaaaacaactgcttccccagcaagagcccccattttggttccaccaatataaaaaacatctgataaggctgcaatcgttgggaaatcaacatctgtatctttcgcagccaaaccataccccagacgagcaccgtcaataaataaggggatttgataatgtttacaaatcttcgataactcttctagttctgctttactataaagtgttccatattctgttggatgtgatatataaaccattcctggaaaaaccatgtgttggtaattaccatcagcataaaaagtctcaatataagttgcgacttcgcttgcgagtaatttcccattatgagaaggtaaagtcaataccttatgccctgaaaattctatggctcctgcttcatgactactcacatgacctgtttctgcagcaataactccttcataagaagcaagcatactactgataactacttgatttgtttgagtaccacccactaaaaactcaacttcagcttgtggacaggaacagacttctcgaattttatctgccgcttgttgacagtaactatctgtcccatatcccgatagaccttgatcattagtttcaataagggcatttaaaagctctggatgagctcctttattataatcattttcaaaatgtaacattccttaactcctttattagttaaaaaaatagcgacaatatcatttgctaatatttttgaatattcaatcattataacaaataaaaaatatcaaaacaagcgttttgatattatgaacacctataaactctcaaaagctaaactaggtttggcattcaattttaaagaagcaaaattctctttttcaaactctatcgctgctgctaatgcaatcattcctgcattatccccacataatctaagaggaggaataaccacatcaatatcaggagaaatatcagtagccaagcgttcccgaagtccttgattagctgcaactccaccagcaacgactaaagttttcactggatactttagcaaagctttttgagttttggccaataaaatatccaaaacagccgcctgaaaggaagcacataaatcttcaagaaccaatgcttcacccttttgttctgcattatgatgtaaattgataaatgcagattttaatccagaaaaagaaaattcaagatgatcttctttgatcatcgctctaggaaaatggtaagtatcttgacccttatgagctaactgatcaatctcgcgacctgctggataagttaagcccataacacggcctactttatcataagcttctccaacagcatcatcccgagtttctcctactattttgtaatctcccggttcagaaacatatactaattctgtatgtcccccactgacaagcaaagctaacaatgggtattgaagttccttaacgtcacgtgctgccattaaatgacctgccatgtggtttataggaattagaggtaatttatttgcccaagcgaaagcttttgctgcagccatacctaccaataaggctcctactaatcccggaccatatgttacagcaacagcatccaaatcgctagcaacaatacctgcttcttgaagagcatcctcaaaacaggttgttactacttcaacgtgatgacggcttgccacttcaggaacaacaccaccaaaacgtttgtgactttcaacttgacttgcaataatattagctagtaactctttatcattttttaaaatagcaacactagtttcatcacatgaactttccactgctaaaatatatctatctttcataatgatattaatccatcaatatcgtcttttccattagtattgaggactattcatatcctttctatcatcaactatttatcccttgcgcatcactatagcatcttcaattggatcatggtaataatttttgcgctttcttaaaactacaaaaccacacctctcataaagtttttgtgctacgatatttgaataacgaacctcaagaaaaactggcacctctatatcagcgatcattgacattaactggtaagcataacctttaccttgataattttttttaacagcaatattagtaatttctacttcacctaccaattgttgaagagccaaaaaaccaatgacttcaccgtcattataaacaaaaaaataatctgttgaatctttttttaaatcttctgaaatctgcgataaactccacggagatttgtcatagacatcagatagtacgctccatatagccagtgcttgttctgatgattccatctcaaactctcttaatatattcttctgtattcgtttcacagtggttttttaaccaattttcctcagcttcaacacgttttaagtatcgtggaacaaacgcatctacattaacgcttttcattttttgtcctttgcgcccaattgctactgcacaaggtaaagtttctgtaattttagcatgtggtaaggctttcttaatctgatcaaaaaatgctgcaacctctccgacaaaatgaacattggctttattccccacctcttgtaagacttcttcaagagaagtgtgacagtctggtttaacagtatcaccattttgatagaaaccaacataaacattattacgtcgtgcatctataagtggtaccaataaatcattttctgaaaatccatttgttaaagcgtacaggctagatactccaactaagtcaatcttaagcgtataagctagcatttttgctgtagcaacagctacacgtaagcccgtataagatcctggaccctctgctactacgatacggtccaaatcttgaggttctaaatcaattgattgcattaaaaaatcaatggctggcatcaaattaatgctatgattctttttgatattgatagtgacagtcgctaaacattccatattgtttagtacagccactgatagtgctttgcttgaagtatcaaaggctaaaactttcatcatttaacttcccttacttgattctacctcttattttatgatataatcatgataattgcaacgaatcaaggttaattctattactctataaaaacttaataatggtttgtcattgtctcacttaacggcattgacccatttttttatagttagaaaaaccgagagataagaaaggattattatgatttataaagttttctatcaagaaacaaaagaacgcaacccacgtcgtgagcaaaccaaaacactttacgttactattgatgcagctaatgaattagaaggtcgcattgctgcacgtaaactagttgaagaaaatacagcttacaatatcgaattcatcgagttactttcagacaaacaccttgaatatgaaaaagaaactggtgttttcgagctcactgagttctagaaaggagttaaacataatagctagagtaatctacccattatgataaacttattatgtcaaatatcaacttaaaacccgaagaagttggggtttatgcgattggtggtctcggtgaaatcggaaaaaatacttacggtatcgaatatcaagacgaaattattattgtagacgctggtattaaattccctgaagatgatcttttgggaatagattatgttatcccagactattcatatatcgttgaaaacattgaccgtatcaaggcccttgttataactcatgggcacgaggaccacatcggtggtattccttttctattaaaacaagctaatttaccgatttatgcaggtcctctcgctcttgctctaatcaaaggtaagttagaagaacatggtttacttcgtgacgctacattatacgaaatccacgctaatacagagctgacttttaaaaacttaagcgttacatttttccgcactactcactccattcctgaaccattaggtattgttattcatacccctcaaggtaaggttatttgtacaggtgacttcaaatttgactttacacctgttggggagcccgctgacttacatcgtatggctgctctaggtgaagatggtgtcctctgccttttatcagactcgacaaatgctgaagttccaaccttcactaattccgaaaaaattgttgggcaatctattatgaagattatcgaaggtatcgagggacgtattattttcgcctcttttgcttcaaacatcttccgactccaacaggctgctgaagctgctgttaaaactggtcgtaaaattgctgtttttggacggtcaatggaaaaggcaattgttaacggtattgaacttggctatattaaagttccaaaaggtaccttcattgagccaagcgaacttaaaaatcttcatgctagtgaagttttaattatgtgtacaggtagtcaaggtgagtctatggcagcacttgctcgtatcgctaatggtactcatcgtcaagttactttgcagcctggtgatactgtgattttctcatcaagcccaatccctggtaatacaacaagtgtcaataaattaatcaataccattcaagaagctggtgtcgatgttattcatggtaaaattaacaatatccatacctccggccatggtggtcaacaagaacaaaaattaatgttacgcttgattaaaccaaagtatttcatgcccgtacacggtgagtatcgcatgcaaaaagtccatgctggtttagcagttgacacaggtattcctaaagagaatatcttcattatggaaaacggtgatgttttagctttaacgagcgactctgctcgtattgctggacatttcaatgctcaagatatctacgttgatgggaatggtattggcgatattggtgcggcagttctacgtgaccgccacgacttatctgaagatggtgttgtccttgccgttgctaccgttgatttcgattcaaaaatgattttagctggaccagacatccttagccgaggctttatctatatgagagaatctggggaccttattcgcgaaagccaacatatcttattcaatgctattcgtattgcactgaaaaataaagatgcaagtatccaatcagtaaatggagctattgttaatgccttacgcccattcttatatgaaaaaactgagcgtgagcctatcattattcctatggtccttacccctgataaataaacaaaagaacggaaaatactttctccgttctttttaattgcctatattagcaaaataagttaatatatcaaattacttctgggataactatagaatataaaagaactccaaacagtatcgtacttttataccgtctatgtgaggagttctttatagattaattcggataaatgtagctaactacccctggtgttactgtattttgtggatcaaaccaaccacgataattatcaatccattgatgacctgcataattagattctaaaacctgaattttattagtgacaggatctacagctgtaacataagccacatgtccataactaccatcagtccaacatacgatagaacccacgcgcggttgtgtccctactgtataatcagctgatgcggcgctcgcagcccaatcaccaccgtttccccaccagttacctgcccatgttgccatctcctttacaccccatgtgcattgacctagtggaaacgtattactagctggatgtgcttgagcaatttcctccgcacttgctaggtagtctacatctactgcatagttatatgtattcgcatctgcatttgttgaagcaaatgaaaaagcggacaccaaagccactgttccaagcattgttttagactttaattgttttatgttcatgttttcctccatctgatgactcctagtttatcaaatccatataacagacaaatgaaaacctgtaacaagttttaggcaattttttacaataatttacaaaaaaactagttttagactttacaaaataaagcctaaaactagttataaacattcttatgattaatataaatctaggtaattatcaatttcccattgtgaaacataagtcgcataacttgcccattcaatacgcttagcgtctaagaaattagtatagatatgagttcctagggccgcttttaccacttcatcttcttcaagtgcttcaagagcattatgaagagtagatggtaaatcaacaatacctgcttgacgacgttcttctacagtcatagcatagatatttgtctcaattggttctggtgcttcaattttattctcgattccctcaagtcctgatcccaaaagtactgataaagcaagataaggatttgctgttgggtcaaccgagcgcaattctaggcgtgttcccatacctcgagatgcaggtacacgaataagtggcgaacgattgcgacctgcccaagcaacgtaaactggtgcttcgtatcctggtaccaaacgtttataagaattaacagttggattaatgatagctgtgtaattgtaagcgtgtttcattaacccacctaaaaagtagtaggcatcctctgataattgcattccacgtggatcttctggatcaaagaaagcattgttcccttcattatcaaaaagagacatattacaatgcatacctgaaccattgataccaaacttaggttttgccataaaagtagcatataaaccatgcttacgagcaattgttttaacaaccaatttaaataattgaatgttgtcacaggcttttaaaacatcatcatatttaaagtcaatttcatgctgtccaactgctacttcatgatgactagcttcaacttcaaagcccatttgtgttaagacattaacaatttcacgacgtgtattatctgctaagtctgttggagctaagtcaaagtagcctcctttgtcattaacatcaagtgttgggttaccattttcatccattttaaataggaaaaattcaggttctggtcctaagttaaatgacttatagcccatctcttgcatacgtttcatattacgcttaagatttccacgtggatctccggcaaaaggttctccttctgctgtatagatatcacagattagacctgcaacagctccattttcatctccccaaggaaagacaatccaagtatctaaatcaggatataaatacatatcagattcattgatacgaacaaagccctcaatagaagatccatcaaacattgctttatttgataaaactttgtctaattgttcatctgtagccggaatttcgacatttttcattactcctaagatatctgtgaacatcaaacggaggaaggtaacatttttttccttaacttcgcgacgaatatcttctgctgtgatagtcatatagtctccttaatatctagcttgactgcatgtttacaaatgcatatttccaatgtgctgtgaaggacttgaaaaacgcccttgattacggagctcatcttgtaaaagtcgacgaacctcggcatctgataatgacttttgtttctctttggacttatgttgtctttgcatgtattcatttttaatatcagaaatatgcaaaccatcgctaatgaagtcttttatttccagtaagcggtccatatcattcagtgaaaacatgcggcggttaccttcagtacgttcaggtgtgattaacccttgatcctcataatagcgaatttgtctggcagtcaaatctgtcaacttcataacagctccaatcgggaatacagccattgtacgcctaagttctctttctttcatgatggcctcctttcattaaaccattataaactttaaaaagtttgatgtcaactctcatgtgagattttatgacatcaaactataatttgttattttttagttttttccgaagtatttcaatatctgtattaaccatcattgcaataaaaacaccacaaaaagtttcaaaaatacgtgcaaaaacatatagaattgtctctccgcttgggatagataaagttataataagtaatgcggctgttcccccaataatacctgatttattattacaagcaacattaatcatgatacataacatggtacaaataggaacaattaataaagtgacccaaaaagcttgatgaaatatctcattgaatgcaaaaaatactaaggagagtaagccacctatactattaccaataattctagaaaaaccaaagtgcacgcttttatcaaagtcttctcttaaactaaatacagcagttagagcaccaatttgaagccctttccaaccaaataaatgaaaaaccaataaaactaaaaagaccgataagcctgttttaaatgttctcattcccaatttaaactttttaatatcaaacttgtaattagataataatttttttaacgttttcatacctatcccttcactatatattctaacatatcaatccataaaaccctttttgtaaacgttttatttattactagtatatcttttataaaccaatttatatcaaatcgtcataaacttttgaaaattgcagtgtcaaccaaataccactatatctaaaaactagtaaatgataaatgaagtcaaggaaagttcaataactctacattatcaactaaaaaaagacatgcatcagcatgtcctttaatataaattataatgactattatttttcagtcaatgctgccaaacctggtaatactttaccttcgagcaattccatgcttgctccaccaccagtagagatccatgagaatttgtcagcacggccaaggttgatagcagctgctgctgaatcaccaccaccgatgattgatttaacgcctggttgtttaacgatagcgtccattacaccgattgtaccagcttggaagtcagggttttcaaagacacccataggtccgttccatacaactgttttagcaccagtaagtgcttcatcaaatttagcgattgatttaggaccgatgtcaagaccaaggaacccttctgaaactgcttcaccttcagtgtcgcgaacttcagtataaccagcaaatgcgtttgcttcttttgagtcaactggcaagatcaatttaccgtttgatttttcaaggaggtctttagcaacatccaatttgtcttcttctacaagtgagttaccgatttcgataccttgagctttgtagaatgtgtaagtcataccaccaccgataagaactttatcagctttttcaagaaggttttcgataacaccaatcttatcagaaacttttgagccaccaagaatagctacgaatgggcgttctggagtttcaactgcttcttggatgtaagcaatttcgttttcaagaaggaaaccagctacagctttttcaacgtttgctgaaatacctacgtttgatgcatgagcacggtgtgctgtaccaaatgcatcgttaacgaagattccatctccaagtgaagcccagtatttaccaagttcttcgtcattcttagattctttcttaccgtcaacatcttcaaaacgagtgttttcaaccaaaagaacttgtccatcttccaaagcattgattgcttcttctaattttgcaccacgagtaacacctgggaatacaacatcttgaccaagtttagcagctaaatcagcagctaccggtgcaagtgattttccttctttgtcagcttcttctttaacacgtccaaggtgagagaagaggatagcacgaccaccttgttcgatgatatacttgattgttggaagagccgcagtgatacggttgtcgttagtgataacgccgtctttcaaaggcacattaaagtcaacacgaacgaggacttttttacctttcaaatcaacgtctttaacagtcaatttagccattagtaaaactccttatataatttgatattatttattataacatatttttgtgaacagttgtaattattgattactttttcacaaatagatttcatagattttcctagttgttttcaagagaattcgtatacttattaatcatacgaatgcaacattttttgtcgttctttcaattgtttttgaacatccagatgttttccttgataaatagcactttcccaagaaccgtacataggatttgggaaaacaataaatttactaccaaactcactttgaagtttagttagtagttgttctctatctgtactagatgatttagaaaaatcagcaaaatcaactaaattatctccaaaaagcataattaaattggtatctttttgaactgcctgacggcgactctctttagatttcattccttttttaaggaaaagcaagtggtctttcccttgaacaggtataccttccttctctaaattttctttagtcgcatcaacttgagcatctgtacgatctgagacataataaatttttattcccttttcattagcatacttcaaaaattctttggcacccgcaacagccttagctgatttcttttgcacccatttatcccaactctctggcgtgaaactagagccatctttaatattctttgcttgatatgggctattatctaaaactgtttcatctaaatctaagataattgaatatggtttttcactgggcttttgtaaccaatcatctaacttcattttagcaacattataaccttgtaaatataaagccttggcttctgcagaattttgataccaaaggacagacatagtgttttccttagccaacagtttattagaacttagagaaatatttttaaatttcgtcttttgctccaccttatctggagacatatcagcttttttagtactgtggtttgactgacatgctgtcatcataaatacagcaacagataacgataaaactgaaaaaacttttgtagtcttcataaaacttctcctctatattttttcaattaaatcataccactgcttactttcaaaatcaaaccttattttaacttatagtcaatataattcatttttcatttattttctgataattttctataataaaatgaaaaaacattcgtattattttttatttataaaaataaaagagggataaatccctcttttacatcatattaattaaaaattattttgcaatttttgcaaagtattcaagtgtacgaacaagttgtgaagtgtatgacatttcgttatcgtaccatgaaacaactttaaccaattggttaccgtcaacagtttgaactttagtttgagtagcatcaaacaatgaaccgtatgaaataccaacgatatcagatgatacgattggatcttcagtataaccgtatgaatcgttagctgctgctttcatagctgcatttacttcttcgacagttacgtctttttcaagagttgcaaccaattcagttactgatccagttggaacaggaacacgttgtgcagcaccatcaagtttaccgttcaattctgggataacaagtccgatagcttttgcagcaccagttgagttaggaacgatgtttgcagcacctgcacgagcacgacgaaggtcaccaccacggtgtggtccgtcaaggatcatttggtcaccagtgtatgcgtggatagtagtcatcaaaccttgtttaacaccaaagttgtcttgtaaagctttagccattggagcaagacagtttgtagtacatgaagcacctgagataactgtttcagttccatcaaggatatcgtggttagtgttgaaaacaactgttttaacgtcgtttccaccaggagctgtgataacaacttttttagcaccattttcatggatgtgttgttcagctttttcttttgatgcaaagaaaccagttgcttcaagaacgatttctacgccatcagtagcccagtcaatgtttgctggttcgcgttcagcagaaactttaacaaattgaccgttaacttcgaatccaccttctttaacttcaacagtaccgtcgaaacgaccttgagttgtgtcatatttcaacaagtgtgcaagcatgtttggatctgtaaggtcgttgatacgagtaacttcaacaccttctacgttttggatgcgacggaatgcaagacgaccgatacgaccgaaaccgttaataccaactttaactaccattagtgatttcctccttatgaaaatctcaaatattttattttagggatccccctaaccaatgtgaaaagattaacttgtacatatgtgcaaaaatctttcaacacaattattatatcttttttcgagaaaaattgcaatgaatttaccactttcaaaaagaaaaaaagatactctttcgagtacctttcataagttttcagaaattattcaccagagtttttcttgatgatttcttcttgaactgacttaggaacatcttcgtagtggtcaaataccatcatgaatgtgccacgtccttgtgttgcagaacgaagaactgttgcataaccaaacatttcagcaagtggaacaaaggcacgaacaacttgtgtattaccacgtgcttccataccatcaacacgaccgcgacgtgcagtcacgtgacccataacgtcaccaagattgtcttctggagctgtaattgtaacaagcatcattggctcaaggatagctggttgcgctgatttagcagcttctttaagtgcaagtgatgcagcaatcttgaaggctgtctcagatgagtcaacatcatggtatgaaccatcgtaaagtttagcttttacgtcaaccattggatatccagcaagaacaccgtttgccatagattctacaagtcctttttcaacggctggaataaattcacgaggaaccacaccaccgacgatagcattttcgaattcgaatcctttaccttcttcgtttggtgtaaattcaatccaaacatcaccaaattgacctttaccaccagattggcgtttgaagaatccacgtgcttgtgtagaagcgcggaatgtttcgcggtatgatacttgaggtgcaccaacgtttgcttcaactttgaattcacgtttcatacggtcaacaaggacatcaaggtgaagttcacccattcctgagataactgtttcaccagtttcaacgttagtttcaacgcggaacgttggatcttcttcagcaagtttttgaagggcgatacccattttatcttggtcagctttagattttggctcaaccatcaattggataactggttctggaacttcaattgattcaagaataacttttgatttttcatcagtcaatgaatcacctgtagttgtatctttcaaaccaacagccgctgcgatatccccagcataaacagtttcaatttcttgacgactatttgcgtgcatttgtaagatacgtccgatacgttcacgtttacctttagatgtattcaacacgtatgaacctgaattaagaacacctgagtacacacggaagaatgttaagcgacccacgaaaggatctgtcatgatcttgaaggcaagcgctgcaaatggctcttcatctgaagcaggacgtgtttcttcttcgtcagtatcagggttaatacctttgattgcaggaatatcaagtgggcttggaaggtaatcaataacagcatcaagcatcaattgaacacctttattcttgaaggctgaaccacacaatacagggtagaattcaacattgatagttgctttacgaatagcagccatcaactcttcgttagtgatttcttcaccttcaaggtatttcatcatcaaatcttcatcagtatcagcaactgcttctactaatttttcacgatattcatttgcttgatcaacatactctgctggaatatcttcttcaaggatatctgtaccaaggtcattagtatagatttcagctttcattttgattaagtcaataataccacggaaatcgtcttctgaaccaattggcaattgaattgggtgtgcattcgcttgaagacggtcatgaagtgattgtactgaatagaggaagtcagcaccgattttatccattttattagcaaaaacgatacgtggaactccgtattctgttgcttgacgccaaactgtttcagtttgaggttctacacctgattgagcatcaagaactgttaccgcaccatcaagtacgcgaagtgaacgttgaacttcaattgtgaagtccacgtgtcctggtgtatcgatgatgttaacacggtgaccatcccattgtgctgttgttgcagctgatgtaattgtgataccacgttcttgttcttgttccatccagtccatttgtgaagcaccttcgtgtgtttcaccgattttgtggattttaccagtatagtaaagaatacgctcagttgttgttgttttaccagcatcgacgtgagccatgataccgatattacgagttttttcaagtgaaaattcgcgagccatttggtttctcctatattttaaattatttacttctttattataacactatttataaaaaacggataggcaggacctacccgttctaattgctaacattgctatctaccaaacaatttgtttagtagctatgataagtctcaaaaagagagtaatcttaccaacggaagtgtgcaaaggcacggttagcttcagccattttgtgagtatcttcacgtttcttaactgatgctcctgtgttgtttgcagcatccatgatttcttttgcaagacgatctttcatagtgtgttcaccacgagcacgtgatgcgttaaccaaccaacgaagtcctaaagttgtacgacgttctggacgaacttcgacaggaacttggtagtttgatccaccaacacggcgtgcacgtacctcaaggacaggcatgatgttttccatagctgtttcgaacacttcaagagcatctgttccagtagcttctttaattgcttcaaaagcatcatatacgatagttgcagcagtaccacgtttaccatcaagcattacacggttgataagacgtgtaacgatttttgagttatacaatggatctggcaatacttcgcgtttaggcgcttgatttttacgactcattttctcttatcccccttctaattaccctttaggacgtttagcaccgtatttagaacggccttgtttacgatcagctacacctgcagtatcaagtgcaccacgaacgatatggtaacgtacccctggaaggtcttttacacgtccaccacggataagcacaacactgtgttcttgcaagttgtgtccgatacctggaatgtaagcagtaacttcaataaggttgctcaaacgtacacgagcaaatttacgaagggcagagttaggttttttaggtgtcatagttccaacacgagttgcaacaccacgtttttgtggtgcagataatttagtgtgaacttttctgtgactgttgtaaccaatattcaaagcaggtgaatctgatttttcaactttagatttacgtggtttacgtaccaactggttaattgtaggcatctacatttctcctgtaagttttttatttttggttgatatagcacttggtgacagcctatatctgcgtgtacttttgcaacaattgtcagcacgtctctgtacacttttgagagaccaaaagtaaaagtaccgtttatcatagtatcattttacacataatgtgtcaagcttttattacttttacaagcaaaaagaatcaaggatgtcaccttgactctttaatcaaatatattccccgcttctacagagactctattattttttacatcaatttcagatactctcagaagagatttataggccatcttctcacgttgttcctgagcattttctgcaaatacagcgacacctactaatgtgctatcgaattctgagagtaaactaatcatccccgaaacagtacctccacctttcaagaaatcatcaactattaaaactcgactgttaggttttaagctacgcttagaaagaaacattttttcaatacggccacttgaaccactagcgtagtttactgacacagtagaaccttccgtaatcttcaaatcacgtctcacaataacaaaaggaacatctaaaacatttgctactgcgtttgctaaaggaacaccttttgttgcaaccgtcatgacagcatcaattttttgacctctgtaagcgttcgctataatgcgaccaatactttgtaacatttttggtgtactgagtagatctgaaagataaatgtaacctcccggaagaatacgatcgttttcagataaacgctgtcttaattcttcaacgatttctttcgcttctgcttcagcaatagttggtgtaaagataacacctccacttgcaccagtcacagttttaatatctccgatttgagcttgttcaaaagcttttttgataatagcaatatcttctgaaatcgaagatttcgcggcaccgtatttactagcaaatgtatttaaactagttaatgtatagggattatttattaggtaatttgaaataacaaccatgcgttcgctacgtcttaatttcatattttctccttattcatagcattctttacatatagtataacataacaaatgctaaaaacgaacattttattttaggtcttaattattctacctaaattatttaatgttcggtttataaaaagaacggttatccatggcaaaaatgcgatttgtcatttcaccttcgttgacacggtttaaagctgttgtcatcatcatcatatttgcatcaatgttatcgatcatatggataatttctgcctccatgattctaggacgaaccgggcttccatattctaattgtccatgatgactcagaataacatggcgtaacactgtaacctcttcttttgtatcatcaatattaagctctgctagtatttttgttaattcctcatcaataagtgaaatatgaccgataagattacctcgaatagtatattctgtattatcaggacccgataactcaatgaccttggctaaatcatgtagcataataccagcaaacatcaaacttttattaagttctggatagatatctccgatactatctgccaaacgaaccattgttgccgtgtgatatgccaatcctgattcaaaagcgtggtggtttgttttggcggctggataggtaaaaaattccttattgtatttacgataaagtgctcttaccacacgctgccaggttgcattttcaattttaaagagcatttgttccatgtactctctcacgttgtcaacattgattggaggtttttctttaaaatctctaggatcattaggttcaccatctttgatgtttcttaatgtaatttggttgacttggggagttccattataaacttcacgacgccctttcatatgaacaattttaccggctacaaactcttctacattataggtctgtgcatcccacatatttcctgaaatttcgccagtatcatcttgaaaggtaaaggcaataaagtctttacctgcacgcgttttacgaacttctgctttctttataaggtaaaacccctcaaaaagctcgtcttttttcatttggttaattttcattaatttcctcttcttctgttataggaaggtttaacaagctagtggttgcttgatcttgatgttcttcaactgtatttaagactctgataatagcgtttgtccgcgttgtgagtaaactatcaatacttttacttgctgtatttaattgtttttgagcttttgataacatgccaccaaattttccaaattcaaccttgacattccctaaaattttactaatatcattagcattcttttgaatatttaaggttttaaagccaacagataatgaatttagtaaagcagataaggttgacggtccagctactacaatattttcgtcacgtcttagactatcaaagaatgttgcatttcttaccacttcagaatagagcccttcagttggtaagaacatgataccaaaatttgtcgtttcaggaggatttaagtacttattgtttatatcttttgcaaatttacgaatacttgccagtaaagatttacgatagagttctatttgaaccttgtcacccaattcataagcatcttccaatcggtaataatcttctagaggaaacttagagtcaataggcaaatagatataatctccctgaccatttccaggtaatttaatagcatattcaacacgctcagaagagccagacaccgtaggaaattctctctcatattgactaactgtcataatatcttctataatttggccgagttgtaactcccctaatattccccttgtcttagtatttgacaagactttgttcagtgtaccaacatcttgggcaacagttttcatctccccaagaccttgattgacgctctctagttgacgcgatacagtttcaaaagaagtttgcaaacgcgtttgtagcgttttttctagcttttcctcaacagtttggcgcatttgatccaagcgtttttcattggaatcttgcattttctgaactgactgagataaattggagttaatcaattccaagcgtttgtctgatcgatctcgactctccgttaaatgctgatttaattctgtacgcatatcggtaagcaactgataaatttcctgttgcatacggtttagctgattagtcaacgttagaatttgatctttttgcgccacttctatctgatatgtcagttggtctgatagattatcagcattatcttcaagttgtttttcaacggactttgttaattccgtcattttttggtaagaaattatcgtcactgtcagactagctagtacaatgatcaaaatgatgacaagcatattaacctctatccttactataaataatgattaagtaaccatctttgagctctacttcaattggcgaagtcataaattcattactggaatacatttttttcttaaaataattacttttgttcaattcatatttagccccagaaatctgcaaagtagactcactctcaggcatgaacgagacataggacatcccttcaatccttgagacttgatttttcccggatggtagataagtcactatgttttgttcatctttgagtctgatttgtgacataaatggttctagatctctgtcacttggtaaaaagatattagacatcatatggtcaatcctgccaccaaatgctccaaatacggtcacctgagcttctggaaattctttgaaaatagtttttaaagctaattctgtatctgtatcatttttttctgcactagcagaaacgatattgctacaatagtgtttgatataaagcagttcatcttctgttatagaatcaaaatcacccactgccatgtccaaagaaagcccattttttaataaaaataggcttccacggtcaattccgacaaaatagtcaaaatcatattcaaaataagttaagtcaccgccagcaaataaagcaattttagtcatcgagcgccacccttaaggtttctacttgtgcaggtaaatcacttgctttaaagagataagaacctgcaacaaagacatttgcaccagcctctgctgctgccttaattgtagtattatctataccgccatcaacttcaatatcataatgatgaccgtactctttgcgccatgctgcaactgtctttacttttgacatcatttctggaataaaggcttgtccaccaaagccaggattaacagtcataattaaaatctggtcaaccaaatctaagataggaataagagattctacgggtgttcctgggttaataaccacacctgctttcattcctgcctcttttatcttttgaagcgcaccatgtatatgtttcgttgcttcaacatgaatggtcatgatatcagcaccagcttgagcaaaagcctcaatataacgttctggatcaacaaccatcagatgacaatcaaaaacaagtttactgtgtttacgcatgctggatacaacatccgcaccaaaactaatattagggacaaattgaccatccatgatatcaatatgaacgtattctgctgttgtctcttcaatacgtttcaattcgttagcaaaattagcatagtctgctgctaatatcgatggggcaattttattggttgacatagaaacctactttcttttaataactttcttatatgtttcacgacggctctcaatttcacttaaaaattggaggtagttatcatagcggacttgccataactgaccttgagttaaggcttcttttacagcacatttaggctcatgtgtatgcgtacacgagcggaatttacaaaaatgactaagtctacgaagctctggaaaggattcgtttaagtcctctgcattatccacttcatagtccaaagaagaaaaaccaggagtgtctgcaatttttcctttatgaacgttatagaaactaactgctcttgtggtgtgtcggccacggcctaaactacccgaaatttcaccagtttcaagtttcaactcaggagcaattttgttgagaagcgttgattttccgacacctgtctggcccataaaaacagtcactttatttgctaacagaggcaagagttcctcttgagaataacagaaaacgtagcctatattctgataatgttcgcgaatatcatcaataacaaccaaatcgtctaacaaatccaacttggaaatataaatgataggctgaatcatcttatattctagaagtactaagaaccggtctaataagttagcgttaaaatcaggttctttagcagacatgataacgacagcttgatcaatattaacaataggtggtcgtacgaggctatttttacgctcttcaattgatagaatatatccttctgattgatcttgcgaagaaaattcaacccaatccccaacgtagggaatttgacctttttttctaaaatttccacgcgcacgtgtctgataaacaacaccgtcagattccacataataaaaacctgctagcgacttgacaattctaccttgcaattgttctccttaattgtttagaataccactattatatcataaaatgagaaataagctctactctcagagataagctaaatagaaactatttgtaggtgttcgatttctctcaaataacctcaattttatgaattcccaacataaaagcagtgatcttatttagatacactgcgcttttttccaattactattaaggcacctactgtaatttctgatatactcgcccaatcaatagtcgttttatctacgctgaataacaacggtgtcatatcaataaaagcttgacgttcttgttgagaacagttatagctttgaacaactttctgctcagaaataatttcaaaattttctctaaagtgatctagaattttttgattagagtaatctttctgtttcaagtattgactagctttttctcgcaattcttgaacatgttcagctacaggaacaacctttacaaggataccatcatcactcagcacccgcctaaattctttataatttgcaggagaaaaaatgtctaaaatgatatcaattgatgagtcttgaataggaaggttagctaaatcagaaacaaaccatttcacaagcctagactgatcacttttagcagctaattgaatcgaatctttagaaatatcaaaagccaagaaagtcttctcatgcttgttaactaattgacgagaataaaagccctctccacaaccaatatctaaaaccgaatgaaactgagaattattttccaaaacctttgaaatagcttctaaaatatgattataatacccgttttctaagacaagctgccgattttcaaatgattttttatcataatgttcatctaccttctttcctccaagaagattaacatatccaaatttggataaatcaaaacaatgattatcagagcatttgaggctattactttcttttatcaagggattttgacatttaggacaagcgaaataacttgcactatcttcaaaacgccacttcttgtcaaccaacatagtttatatcccaacctctttcaaggcatctgctaaacttgcaaaatcagggatagataaggcttctccgcgaatagatggcttaatttttgctatttctaatgctttttccaattttgctttagtatcttctgattttccaaaatgactcgttagattattccaaagtgttttacgacgatgtacgaaggctacttttgacactctgaaaaagaaatcctcatcttgaacactcactactggttgatctctacggaccattttcaaaatagctgaatctacatttggagcaggaacaaaaacagttctcggaacgataaatgatactttggcagtcatataatactgcactgcgattgacaaagaaccgtatgctttagtatttggcatagctgaaatacgatctgccacttctttttgtatcatgaccacaaactccgcaaaaggaatcttgctctcaatcaagtgcataaggattggtgttgtgatgtagtaaggtaggtttgcgaccaccttgataggcagatcaggattcttgaaagcctgaatctgggtctgcaaatcagccttgaggatatcctgattgaccacttggacattgtcaaaacgcgcaagcgtatcagcaaggataggaatgagacgatcatcaatctcaaaagccataacctcagctgcattctcagccaaaaactctgtcaaagccccgataccaggaccaatctcaatcacgttgacacccttgtcaatctctgccgtgtcaacaatcttctgtaaaatattagtatcggtcaaaaagttctgaccgaatgatttcttaaatgtaaacccatgacgctccaaaatagcgcgggtaacggttttatctgcgattctcataattcctctatttcttaatattgatcatttttgaaataacatttgaggctatttgtgatattacaactggattataccactacttccttttgcctttactattctgagttataaacttatttttaattgcagttgcacaagcttcggttagtggtcctcctattgcttgcttataattaaatccaatcaactgcattgtttttaaagtatctttattcaataatgtaaccaattgtttcattgttcgttcctgttcctcatttagaccagaaaaattatataacaatgagattccttgctcgagagtattggatagatattcaatatcctcatcatctatattaattttttcatactcttctttatatgactgtgcaatgcgaattgcttgctcccgttcagctaataattcgttaattaaatcatcataagtagctctcaatgttgcagcatcttttacatcctttattgattgaattttactggttaccatagttgcagtccctttgactgcaagcgttgctaaatctaccccagctctagtcaatgcttccgttacattatactccactatttttctccttttctattaatacccctccatacactcttcaacttctgccttggtcactccgaagagtctgaggcgtttgaggagttgtttaccatttgagtagccgatacggagttgattcccaagatactcacggcgttttcggctatcgctagcagtaatgaatccccaacgaatgaggtctgcttgggtgatatcgaaatgatcttcatcatcgaaatgctgagtcacttttgagagtgccttctgcaaatcttcaaagctggcatgctcgacacccagagatcgtcccttggtctttgagcctggctttgcctcgtctcgattgaggaaggcatggcggactgtcggaatggcattcatgatgattttacggatacgctcgccattataatctgggtctgtaaagacgataactccccgcaaattgtgcaaacgttcgatacgctctaaatcatcttcatcaattgctgaacctctagtttcataggtatcaacattgtaaaagcgtcgcagattagcagtatcatctttcccttcgacaacgatcacttcttgaatatcaatttttttcatcaagtctaaatatccttactgcattttggtatgtagcctccgctacctcttccacagttatgcctcgtagctctgctattttttcaacgacatatctcgtataagcggttttgttttctcgacctcttttaggtacaggagccaaataaggagcatctgtttccactaatatcttatctaatggcaactctcgtgcagcttcttgtacatctaatgccttcttaaaggtcacaacaccagaaaaggaaatcatcatccctaaatcaataaatttctgagccatttccaaagaaccagaaaaagagtgcattataccaccaaaaggcccaactccagattccttaatgacttcataagtgtcttctaacgcatcacgtgtatgaacgacaaaaggaaggttatactcttttgaaagttcaatttgacgcttaaacacctcgatctgaatatctttgggatcctccatccaataataatccagaccaatttcaccaagtgcaataaccttgggattttctaaatgactgataatcattgactcaatattatcatcataagaaccagcttcagttggatgccatcctattgtgctatatacctgtgcatattgggaagataattccaaagattttgaaatggtatcttggtcaaagccgacaacattcatttttgtaacaccgagttcgctagctaaattaatttcctcgtctatctttccttcaaaattttctacgttaaggtgggtatgggtatcaaatatttttatcatatcatcgttctttctttgcttatcgtagctacaagcattaatctttattattataacataagactgaagcattctgatcagaaagagtaaatcaaaaaagtcaaaacatttttgctctgacttttgaatacttgctgtaaaaatcctctacaagtgtctagctaatggtagagaaactagactataaatgattatatttttgctgattgctttcaatagcctcctcaacctttgaacgaaattctccttttattgcctcgtccaattgattagcaactttatgaatagctgtctttgtgttgatggctacttcgtctatttctttatgatgcgacgtaataatatcgtgaaacttagatctcttgcgtggcgcgtacacgctatgtatcaattctttatccaattgtttttttaaagtccttactgactccttaccagtcaggacatcccacattaaactcaataatttctcctacttcattaattctcttttcttttccctttgcaactcttcaaaggttagttcatgttctgaacgttgccgaatatagttagctctatattcttcttcttgagcggacaaggcatagtactctttatggtaagcttgctctaagtcgtcatgataagaatctaaaatacgattgagcgtcatcatatctgagctatcattactatatctcaaatcatattcaacagcgtcgtaagtttcttgaagcatattaataatcttattttttcttactgagagatcgtctaatttttcttcaaactggcaacaactatggtgataggcatcatctaaatctgatatttttctctgagtatcagctaattgtttttcaatgatatcaatcagtgccattgtttaaactcccctgacaagttactatcttgtcgcaacatagcttcaactcctttattaatttggttttctaattcaacgtaagcgtgagaaatgctttctgccgcttgagttttatttgagaaaaaggtttgagcttctccgacaatgctcgcatagctaacacctgactgagcatacgcttcttccaattcttgaggacttagttcagtaactcctgtaggagctacttttaaagattgataaagctcttctgctttagcaactgctttttgctcaacttttttaacttcttcaactgcttcttttgatatcgttaccaaaccactagagatcacttttgcttgttgactatctaggaaaatagcttgattcttactaacttcttttcccgtacttttaaagctactaagtttcgctttaatagcatgcattctttgattcacattcgtatgaactactgaatagttttctttgtaagcaaatttatcttctgctaattttaaagaaccatctggattgtactggtagcctccccaaatatgctgattggtaaaattagcaacccagctacctcctgaaacagctttactgtcaactattttaacaattccgacagcattatcgcttccttctttaggataacctattccaattttatccttggaatcaacgtaattattgaccaccccttttattttatcaacctgttctttttgtttatctgtcaaaatactataaaggtttggaccgttatatatccaagctccttgaactcggtaaatttgattatcatccaattctgcaatagcatactgtgcattcattgaccctaacgagtgtccgtagaccgaaatttttgcgttaggatatttattcataacttcttttagcagatgagctgattgttctaactgctttgtaccttgtttatgagatacactttgtgaaccaaatttctttaataatagtttactagctattggaatatcatttttaaaccagtctgttttccaatcatcccctccaaacggtgctgttgaccccttaaataaaaccgtaacttccttaacatcctctggcttgtctaaagttccatttggagtgatggtataaatttgttccccggtttctttgcctccatcttgaacgtgagcaactttaccgatggggagtaccttatcttggctcattattttgactagtgtatcaagttggctacctaattcatactcttgcttcgctatatttaccctatctaaatcagtcaagactttttccattaatgacctctactttccaataaatgagttaactggggagattgatggctactttgactgaccaaatgcccttgattatccctatccaaattacaagtaatatataagttaggatctttattaatgattaaccttaccgaaatccctcccataggattttttttgatactttctttgtcaatatcatacgacttaataacagcattctctttgaaagcatcttcatcttctgcataaatccacttttgataagcatttttagcgtctttgctattagctatttcccataattcttgttgtttattgttttcagtcacttttaaacctcctacagtgaaaccaagccctaaaaggattattacaataaaactaagtaattttattgacttcatctctcctccttttatcatataacactcatttgatatctagtttatcataaatttattctcattataaatgaaaaactataaaacatggattagttatcttaggattaccaaatacaaagatattaaaaaagatgattaatagctctaatgctataaatcatctgactctactatttacttgtaatcacttggacgtcctgtatattttgcccaagatttcttcaaaaatttattattaatgtgataattcggcttgctgttttcctctgttaaaaatggattgatatgcttatctagctctaaccaaccattccaacctaaatggattgtatcttgcataaagtatggcttacctccatctcgagaaaggtcagcgatatgattgaaaccttgactttgaagttggtgttttattttttctacagatttttgatacattttttgatcaagccctgtgtagtctgtccactttttatttactggtggtatgacaaaaaggacatctgtattttgttttgagaattcattaagaaccaactgtaaatcattaaattctggtgacttagtataattgaaatgtcgttgtgaccctttcaatttttttaagtgctttttaattcttgtttggtaaaagcgatcatcaataccaaattgatttgatctcgttgctactttagcatcttgtgatgcaatacgcgataaatgattatatgagaatgctttcggtaatttaccaacatgaggcattattgcctgattataagtttttcctagtggtagatagctaaaaatagcatctgtcttctcaaatacccaatcattaaactttagtctttgtttgtctttatttgatagtttttggccatctgcaactttttctatcaaatctgacatagaagcttcaggatataattttaacaatcgacgagcagcatacctatcgtaggttgtccctgtttgattttgcaaaaatcgaatggtttgatcgttgctgaaatagttttgaaaagcacctttgttggctcccttgcgaacaaaccattgcggagaaataacatagatagcttttttatttttgatttgtcctttaatctgttgaatgccatagtattgtgtcagagaagccgcccctttttgacctaaaagatatgggatataagacctattgtaagcctctgctaaaactgatggatgcattgcgtcaaatcttagccactcacttgaaccaaagaaagggacaaaattggctttaggatcactgaaagctctaactttttgaactctgcttttaaaacctgccttcgtcaacgctactgcactgtttttttccttacctaaatgatgaggctgagaaacaggaaaaacaaaatataatcctaccaacaatagtaaagcacaaactagaggtccaaatactttacctagacgtttaagcattgcagagctccgttactccagcaacaattttattagctgtgttccagtcattacgaccaaattccgcaatcggaatatcaatattaaagtggctttccaactcaacaattagttcaacagtacccatgctgtctagaactcctgcgtcaaataagtcttcatccatcatagaagaaacatcctccataaataggtcatcaataattgctaatacttctgatttaatatccattataatactccttattatttgttatgcggttgtgggaaccacaaaagatctaaaaatcctgaaaaaatcaagaaagaaaacataactacattaaaggtgatgaagacacccaaagcataagtccatttgttttctggtaaaagtggttttttagccaatcttctttctttattaatatttttcttcttacgtacccaagcgtcattaataactaggccaatcccatgaaagagaccataggctatatagtaccaagttaacccatgccagaatcccataagaagcatattgataatataagctacacttgaagtaacattacggtttttaaaaactttatttttaactaaaagcttaacaagcctcatgaaaacaaagtctctaaaccagaaagaaaggctcatatgccatctattccaaaattcttttaggtcgcgtgatttgaaaggtttgtcaaagttaatcggagacttaatccccattaggttagaaatagccaacgcaaacattgtgtaacctgcaaaatcaaagaacaaatcaaaaccaaaggcatacataaccccaagtgttggccaattaaacacaccaccctgttctagcgctaattcttttagaggaggcataatcagacttccaaaaatataggctaaaataaacttatagagaaaacctaacatcaaataatgaatcgcttgacctaacatatctaggagttcgtttcgatctgggatattaatgtaatcctcattgaatcgtttaaaacgatcaattggtccacttgagaaagttggaaagaagagtaaaaatcttaagaattcccataaagtaaattctttcaagacaccgtctctcatttcaataatcatagcaacagctctaaaagtaaggtaagaaattcctagaaacccaaaaagtgactgatgcccatcctcagatatagctggaattaattttaccaaaaatagcggaaaaatagataaacaaaccgttacataaaagaccaaagtatgattaaatcgtttccggtaagctttatagataaaaactagcagagactgtccgacaacgtatgccaatagtgacttcaattgattaaaagtactaccagtcaacatcattacaataaaacttagactaaaaataatctcatataaggcaaaacgcttcttaaagaataagccgatgtaaattggtaggacagctaagataaggtagaagaaatattgtggattcccataaacatccaagtgaggaagtttttctaaaaatgcctgtatcacttgtttacctcgctcataagacctttgatatcaattttcccatttggtgtcaaaggtaaatcctctcgatagataaatttagatggcatcatgtaatccatcataatgtcctttaagtcttccttaattgcttttgtcaaatccaaatcacgttcaaaatcatctcttacaccttcttttaagacaatataggctaataagttttgaactttatgatccttgttataacgtggcactgctactgctgattttacatactgcgatttgtttaagttttgagaaacatcttctaattcaatacgatagccgttaaatttaatttggaaatccatacgcccaccgtaaagcagaagaccttcatcggtcatacttcctaagtcaccggtatggtaagcaggtagaccttcgaattggaaaaatgcctcagctgtcttttctggattgttaagatagccttttgatactgctggtccagcaataatgatttcaccttgctctccgtttggtaatttatgaccttcttcatcaatcacatacgttggtgagtcatctttagtgtaaccaattggaaggcgtttgcatgtttctaacatttcatcagtaattgctactgcggatagagcaactgttgcttctgttggcccatatgcattaacgatacgagcttttggaaaacgttgacgaagtttttgtgcagtcttgacagttaactcttccccatcaaaataaaaatgtgttaactgtggcaaggtctctgaattgaaatcgttagatagtagcgccatatcagcaaatgatggtgtcgaagtccaaacctgtattggcaattcattaatggtagcgaatagttttttgaaatcattaactactgtctttggtagggcaaacagggtgcctcccatagctagtgttggtgcccaatacataactgataagtcaaatgaatatggcggttgagccaacatttgcggtctttcaggaactgaaaactcatcatcagaaatcatccaatttgtaaagctcaataaattgtcatgtgaaatttgcacaccttttggtaaaccagtagtccctgaagtgaaaataatatagtaattatcatcacctttaacagaatgtgttacctcataaggagtcttttcttcaaaaatagctgaaacttgagaaacgtctaggattgggacattatcaacttcaagaggaaattcaccaattgaaatgataaggcttggttgagcaactgtcataatagcctgtattctatccaaagcagagtgttggtcaaccggtatataagcatgccctgactttgttaaagcaacaaatgtcgccaacatttcatattcttgaccaccgaatactaagacaggtgatttttcaacaaggcctaggctatcaatatgagcagctagagagtcagagtctactttaagttgtccataagtatggacttcccctaaaatatcatacactggaaaatcagcttgtgtctcagcaaaatgctcaattgttttaatcatatcatgtatcatttgtaccatctcctagaattcattataaataaaactgccttgtccgcgactaaggtatgcaaaaaagtaaattagtaacaataaaataccgaagtataataacgttctaccaataaaagataaatatggtttcatcattcttcctttaattaatcatggtattggtccaaaatccatcaattggtaactggacttcaagacgtaattggtctttttcttgatatgctctaattctccccttatggcgttccacgattgctttagcaatagataagcctagaccaaaactgagagaatctgcatgatcatctttagcttgataaaaacgctcaaagagattatccataacctctttggaatagatagcacttggatttgatattgtcagaatagcttttcttcgagcttgtttaagactaaactggattgctgattttgacaaagaatgcctaatagcattatccaaaagaattattaaaatttgcttaatctgactctcttctccaacaatccagacatcatcttcaatcgtatcatttaaacacttttcttcttcatatgccaaactttcatatgttagaagtacttcttgacataagacagataagtttaactttttgaaatttaccttggagcgtttttcatcaagtctagacaaattaagcaaatcttcaattaaaaactccattcgcttagtctccgaaacaacatgatccagataacgattccctggaatttgctgttccagaacctgaacgttggctcgtatagctgcaataggggtcttcagctcatgactcgcatctgaaacgaactgtttttcgcgagtcatttctgtctctacaggtcctacaataaatcgagaaagataaagacttacagctgctaataaacaaaatccaaaaatagtaaaaacaagaattagaaaacgccttgcataagggacttcataactagccaaatccataatagctatggtgtaggttttatctttatattcttttatggaatatataaaagacttccattttcgtgacttctttccttgctcaaggagcttcaaactagatttttcgataacatcatttgtcaaatcagtattattgctttgaatcttaaccatcttttggttatctatagtcaccaaagcaatcggttcatcgcctggtattcctaaataatcatttttggcaactaatttaacaatcctatatgcatcatattcatcccaatattgattgtagcgattactaactgcaaatagaaagagaacaacgacaataaggattgacatggtcaaaaagacaaattttttgcgtaaatcactaaacattatgtcctctcctccaaggaatatccaaagcccttagtggttattatttcaatgtctgcttttaaaaagcgcaatttttttcgcaaaaaagaaataaatacttctaactggttatattctgaattgtctgaaggtccccaaaccttagaaatcaactgatttttaggaataatctgctttgcatttcgcataaaaacttccatcaagagaaattctttattggataattttacactactttctttagattctagctcatgtgaatctgtgttaagccttatatttccaagccgcaattgatttgctctgattagagaagattgtctggttctcagcctaattctagctagcaattcatctgcttcaaagggttttgtgatataatcatctgcccctaaatctaaaccattaactttatcataagtctgtgattttgcagttaaaaagattattggggtttctaaaccagcttccctcactctttttaaaacagataatcctgagcgtttgggtaacataatatccaacaggactaaatcatagagacctgtcaaaatgtattctaacccatcatctccatcaaatgctaaatcaacagaataacctttatctgccaataaagcctgaatagcctctgctatacttttttcatcctcaactacaagaagtctcattttctagtcaccttaccatatatattatagtataaactagcaaaattgaaataaccttgaaaaaacgatattaataaaagtatttcctaagtcactaaactacttcaataatacaagcgtctaaaaaataaaatatcactcgctataaagatatttctcaataagaaatctcctcatattttaacaaaaataggggctatttgtctacgaatttccgcattataaactcacttttcattaactttatctataatatactcaaactactctcacaaaaacctttatcgttatgaaggtaccaaaaaagccaccagactcgagtacctgttggcttgatattattttgctatctatattaagctgataacactttacgtcctttacgacggcggctagcaagcacgcgacgtccgtttttagttgacatacggtgacggaatccgtgtttacgttggcgacggattttacttggttgataagtacgtttcacgttgaatacctcctgatagattttcgtattcgtttagccggctattttgatcagttactaaacataccatactattttataacaattttaggcctcttgtcaagaaatactttcaagttcatttgtcttttttcagtaaatagttccatttgttagcaagaaatgcttctctattttctccaactaaaagaaaagatgtgccatcaaaacaataataggtaatgaaataattgttctctctataaaaatgataaataattctagaatgttgatagggatcttggaacctaatatcaccgcaccagtctcagacatataaattaattgcacaatagaaactgttgcgacaataaatcttgtcatctcactgtgaatttcagccgccattatcgaaggaacaaccatatctgaaaaaccaacaatcatggtttgactcgcaatatctgcttctggaatccctaaaagttcaaggaacggaaggaatggtgtacctaaaattttaaaaataggtgttgatactgaaataatcaaagctattgttccgacagtcataattgttggcataacgccaaaccataaactaagtactgtcttagaggcattattgacaaaagtcttcatgtttccatttgcttttgatttatcgatggcaagcttaagtccccactctatcttgttataaccatccggaattacctcagatgtttctttctttggtttagtgtaataactatttgattgacgagataagggagggatataagggataatgaatgcacagacaacactgctaatgatgactgttagataaaaatggccaaaataatcagttaagccaacattctgcaaaacaacaagacaaaaagtgattgatactgctgaaaaagtagtggaaatcgttgcagcttctctactggtataataaccctcaacatactgcttatcggtcaaagcaattccaatagtaccatcacctacaaatgaggctacacaattaactgctgaccgaccaggtagctgaaagaatggacgcataatgggagttaggaagacaccaacaaactccagtagaccaaattctgtcaaaaatggaagaataaaacccgcagcaaggaaaatggtaaacaaaccaccaatcaaatcaaaaaggataaggccgcctgtctctttcccccataccatttcaggaccaatatgtaaaaccgtcatcagaccaagtgccaaaccgatcaaacgaataatcagccagaaaatggtaatgtcagaaatttcttttagcaagtcatttttttcaataaagctaggtctaaacagacgataacaaagtgctaacacacatgaaataaaaatgattagtaaaataatataatgtataggaaaaacagcgttaatccattgattaattgtcttagagattacagagacagctactgttgtcataccattatatttaaatggagtcattaataataatactccaaataacgacggaataataaaccacaagatatctttaatagatatactttcttttttcatacaatcctcctggataatatggaattgtttctaaatatactcataacttccattgtaaaattttataataaaaaaaacaaccttgaattaaagaaaattttacttagtaatactttagtaatttctcaaagtaagttccgtctgccctccaaaaccggaagttagtgtgaaaaggatttttatggtggaattaagtctgagacgtttgggttagaaatgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatctaacctaatcaactaactgatacaacctaaacgtctcacactaacttcaaccatagcggaacttaatctgaaacgctttcagatgaggatgttttcttgtaccctttttttgcgatttttaactctgaaaacctatgaaatcaagtattataaaaaccaacggaacttagtctgagacggattttcgttggtttttattggtttttatcagactaaattccatttctactagaggtggaacttactttgagaatttagcttagtaatactttataacctgccatttctttcattctctcacttttgatgtattaaaataatataaaacttatattaaatagctaaaacgacttaagtcacattaaaaaacacgctctaaaagagacgtgtttttttctatactatttagtccactctgaaacttcttttttgtggtttttaatccatttttgagctgctttagcaggctccatacctttatccatatctaacatgatagattccatatcttctttagtccacttgaacttatcgataattttatatacttttggcatatcttttttcaaattcttgcgtgctattgtattgatatgttcttcaccaccaaatgatttcttaggatctttaaggtattttaaatcatacttagcaaacatccagtgaggtgaccaacctgtaatgactacttgatctttgtttttgatagccttccctaaggttgttgtcatagctcctgttgatgctgataacaacttccaacttgaaaggtttggataatctttaagggattgtttagcagacttcataatacctgcacctggttcgatacctgtaatttgtttatctgcttgatttgataattcttcaatactatttacgttcatgtatttaggaacaactaaacctattttgacgttctcaacgtgaggacctaagtcatctaaactatttttgtatttattaaaatattgcccgtgggtctttggtaaccaagcacttgttgtaaaatcagcattcccattggcgactgtttgccacatgaccgcattgtcaagtggtgtcaattcaacatcatatcctttagattttaaaacttcagcaataacgttggttgaagcaacttctgaatcccattggacataagctatcttcactttttgacctttggcttcatttcctgaagtcatattgacaacaatgcgaccaagagctgctagaatgaagagagccagggcccctaaacctacccattttttaacttttgatgttttagcttgcttctcacccggtttggaattaaagaattgactaacacggtctaacacgattgctaaaataactagcgatagaccactaacaaatcctgtaccaatatcagcatgttgaagcgccgataacacctcacgaccaagtccaggtgcaccgatcatagatcctgtaaccaccatagaaagagccaacatcatagtttgattgattcctgccataatagtgttcttagcaagtggtagttcaactttgaataatttttgcttaactgttgaaccaaatgaatcagatgcttctattaattcaagtgggatttcacgaatagccaagttagtaaagcgcactgttggaggcagagcaaatacaacagaggcaaagacacctggtaccataccgataccaaagaaggctactgcaggaataaggtaaacgaatgccggcatagtttgcataaagtcaagaattggattaacaacttgtttaactttatcactttttgccatccaaatacctagtggtacaccaataataatagaaattaaacttgctactaaaaccaagttaaaagtattaatcaactgttcccacagcccttggttatagataaatagcaaaccaatgaaagtaaatgtcggtaattgccattttttcttagctaagaaaaatacagcaattgtaattagtacaataaaaagtaaaggattaatgaatagtaatgtttttgtcatccaatccatcaatgcattaccgattgtctggataaagtcaaataaaccagaaaaagttttcgtaatccaattggtcgttgactctacaaatggtgcgaccggtaacttatgttgtaataaattttccaaaatgatttgtcctctctattaagcttctaccgtttcttttggcgattctactactgtttcatcttgaacgttagcaagtgcttcgatcacacgtcctctaatgataacccctaggagtctatcattatcatcagtaacggctatcggagcagatgaatcataaattaaaggcatgatatctgtaataactgtatcttttgagaccgttacaacatctttatcaatcacttcagaaagcggcaaatctttcttacgagcttcaattgcagcatctgcagttagggatcccagaagttggcgacgacgattcgttgccattaacattgagacttcctcacgatgcattcttgttaaagcaacttgtgggccatcaatttctaaaacagttgttaaaggttttatcataatattttgagcagttaacacttttgagcgatcaacgtcttcaacaaactcacgaacaaaatcattagccggattagtcaaaatctcttctcctgtaccaatctgcatgatttctccatctttcatcagagcaatacgatcaccaatacgtaacgcttcattcaaatcatggctgataaaaataatagtttgtttattcgtgtcttgaagatcaagaagctcatcttgcatttcacgacgaattaatgggtctaaagctgagaaggcctcatccatcagaaggattttagggctgttagcaagggcacgtgctaaaccaacacgctgttgcattcctcctgataattgactggggtactgatctttaaacggtaatagacctgcattgtccaaagctttttcagctaacgttgtacgttcttccttagaaacaccacgcatctctaacccaaactctgtattttctaaaattgtacgatgtgggaaaagaccaaaattttggaaaaccatgttgatatcatgacgacgaatgttacgtaaatcttctacattcatctttgcaatatctttaccatctaaatagatatttcctgatgatgggtcaatcaaacggtttaacatccgaactaaagttgattttcctgaaccagaaagtcccatgataacgaaaatttcgccttcttttatttcaaaactcgcatcatagacacctacagtcgctcctgttttttcaagaatttctgtcttactttttccttgcttaaccatttcaagagcagctttttgctttttcccaaaaattttggttaaattcttcacttctaaaatatttgtcattcttatctcctactaaaaatttcgtatcttatttttaaggttatgtgtcttatctataaagtgacgttaagttatcgtaaaagggtagtcacttttttactcaaaaaaataaactgccgaaacagaacataactataatatcatgtatggtctctttatgtcaacacctttgcttagagatattttaattagcccacaccattattgttatggcattattgaattatttaaagacttattagtattaatattacaactttaaaagtgaccacttaatacttttgaaaaagcggtcattcttctataaaataacaaaacacccttagaaaaaatctaaaagtgtttttgtttgtaagtataggcctgaaaaaagtgactacttgatattttcccatttccaattttgtacttctggaatatcgtctccgtgttcacgaatatagtctttgtgataagcaaccatttgattcatttcatcactgaaggcttgtgctttatttcctaaagaagcaagagctgcatcctgtgccagatggaatcggtccaattctgacatcacgcgcatatcaaatggtgttgtgatgtcaccattttcacggtaaccatgcgtatgcaaattatgattgtgacgactaaagaaaatatctcgaatcatatcttcataaccatggaaagcaaaaataacaggtttatctgtggtaaagactttgttaaactcttcatctgataaaccgcgagcatcttgtgaaggatgacgaagttttaggatgtctaatacattaacaaatctaatcttaagttctgggaaagccttatgaagaatgctaatagctgccaaagcttctaagttaggttctgttcccgccgcagcaaagacaacatctggctcttgattaagcgacacatttgaagcccagtcaatcaccttatatccttctgccactaactcttctgcttcagcaatagagtaaaattgtggacgagggtgcttagatgtcacaattaaattaattttatcttcagctttaaacgctttatccataacagctagaagtgagttagtatctgctggtaaatattcacgaatgtattcaggtgttttttcagctaaatgagttaaaatacctggatcttggtgagtataaccattatgatcttgttggaaaacagttgaagctgcaattaggttaagcgctggataatttttacgccatgttgtgtgtgtttttgatttacgtaaccatttgaaatgttgtgttaccattgaatctacaacgcgaaggaatgattcgtatgaagcaaagaagccgtgacgaccagttaaaacataaccttctaagaaaccttctgcttggtgttcagacaattgggaatcaataacacgtccagctggacttaaagcttcgtcataatctggtttacgacgaccaagccattgacggctagtacgtgtaaacacttcttgaagacgatttgatttcgtttcatctggaccaaaaatacggaaattatctggattagcatctaccaaatctgctgcatattttccaaattcaatcatatcttgtgccataatttgacctggaacattaatatcaagagcaaatttcttccaatctgctgtatccattgctttaacaataccagcattggttattggattcatggacatgcgacgatcaccttttggtgaaatagcagcaatctcatcaacgattttaccattttcatcaaataattcttctggacggtatgattgaagccatgacaaaagagaatcaacatgttccatatggtgggcatctactggaattggtacttggtgagcgcggaagccaccttcaattggtgttccttcccaagcttttggaccagtccaacccttaggaatacgtgcaactaagacagggaattttgcttggatagcttcttctgctggtttttgtcgtgcttctgattgaatggttttaatctcttgaatagcttgatctaatttttctgcaaacaaagcatgagcagccgcatgatcctcagagagttcaacaacatctgcaaaaataggtttccaacctaatccttcaaaaaactgagataattcttcatctgtcttacgttcaaagatagttgggttatggattttaccaccatttaaatagaagattggtagaacagcaccatcatttactggattgataaaggtattagatagccaaccagccataagtggtcctgtttcaccttcaccatcaccaataacagtcgcagcaataacatctggattgtctaggatggcacctgtcgcatgagaaagtgcgtaaccaagttcaccgccttcatgaattgaccctggtgtttctggtgcagcatgggatgcaattccacatgggaaagagaagattttacataactgcttaaagccatcctctgtttgctcaatatttgggtttaattcagtatatgaaccatctaaatatgaattagataccataacttgaccaccatgacctggaccttcaatatagaacatgtctaaatcgtatttattaatagcgcgatttaagtgagcatagataaaattttgtccaggtacagtgccccagtgaccaattggatgaacctttaagtcgttttcaaccagctctcgtctcaagagagggttatcctttagatacatttgtgctgcagaaatataattagctgctctccaccatgcatcaagtttttctaaatatgattttgtatcaaattctgacattatttctcctaatcttaattgtgattttagtaacatattttaaaattgaaaaactgcatatcatgcgacatacagtctctcattagccattatagaagtgctttaaattgaatatttgattcttgttcgaagcaatcatcaaaaccacgtgggtgatggtattcaattctatctttatcttgtggataagtgtatttacctccaacttcccaaataaatggatggaagtcatattgaaggcgttctttacgcattttccacaattgtaagatttcgtctgtagaagccatgaagttagaccagatatcgtagtgtacaggaataatgactttggcacggagattttctgccatacgaagaagatcgattgaagtcattttatcctgaataccaactgggttatcaccatagttgttaatagctacgtcaatcttgtagtctttaccatgtttagcaaaataatttgaaaaatgtgagtcagctccatgatagattgttccacctggtgtttcaaaaatatagttaactgctttacgagccatttcttcatcagtcacggctaaaccagcaagttctccatcatgttcttctgcaccatctactggaagtgtcaccaagcaagtacggtcaaatgattcaacagcagtaactttgatatctttaaactcaaatgattcacctggtttaatcacgatgattcgttcttctggaactccccattttttccaaatttcaccacattcatatggcccaacaaatttaacatggtctaagttaggattattaataatggctgccgcagtgttgatatcaatgtggtcactgtggaaatgtgaaacaagatagtaatccaattcattaatagcaaatggatcaataaccattggttgtgcgcgtaagtttggttggagtttacgaacacctgccatattagccatttggtgtccacgaaccatatcttttactttttttgttgatttaccgcggtttgaccataggtccataacaacattagcaccacctggtgttttaatccaaacaccacagtttcctaaccaccacattgcaaagttgccctcagcaacaacttcttcttcaatttcttcgtttagccatgtaccccattctgggaatgttgataaaatccatgattctctagtaatatctttaacgttaggcattttatttcctcctgattaattgtttcttacatctactagtataagttcaaatacttttgaaaaaaagaccaagtgtcacacatttatgtgttcaaaactgggctgtctgttccaaattagactcataattttaattaaaataagcacaaataaaaagtactcccattaaaagtactagctttctcaactttaattatcatgtcatagaggaactcattgcgattaaatatctagcacattgtttaaaagcaccaaaaaagccccagcttctttttctgtcttcagaaaagctgagaggctaccataaaattatattttaacaaactgtactttgaaggggaaggacgtcttggagcaattcttgatgaataagtttctcaatcttagatttcagcacgtagcgttcactatcttccttgacatattgagcaattgttttttcaagttcattggtaaattgattactatttgcacagttaccttttttagaaaagcgaatcaagcgaataatatcatcatctgtcaaaacagggtgaactactaacatcggaaaacgagattctaaagcatcactagtagagacaaccatatctacatgcataagatcactcacactttgatactgttcggttgtaaaaacagcttctatatcactatttgttaagtagcgttgacattgctttaaaagaagtttctgaatcgctattccttcatcagatacaataactaacttaagtttattaggagattgttgactattacgaagttcccctcctaaatgaatcgttagatatgctacatcatcatcggtcaatttgatttgccaagctttctctaaaagctttacagaagacgaggttatggcaaaaagttcttcatatttgtctttaatatgctctgttaaaggattaacagaaaaaataccataacgtttacgatataagagtgccttgcagtgagtaagaagttgtcttagtaagtcctttttatgaacaaagtgaaggtgatatcgttcttccaattctttcaaaaaactggttagagtagctcgcatatcatcataatcctggctctctaaatgattgtcacggtccttgcggaaactaagcataagcatggctactagtcccacttcaatctcatccagtgataactgaaaattttcttccagctcatcagccaactctttagcaatctcatattccttacgttgccaaaccaagctaaaatcactattaagagaggtctgtacttcaggacttaatcgcatcttacgataagccattagtataaaaggcaaaatctgaatcataaactgaccatcttgactgttgattttcttacctagacttcgttgagaaatgaagagataatgatgaaaataatcaagaacctctttagaaaaataagtgctggcaccaaaagcttgagacagtttatgattaaaaaggtctataaaactactacttccattatggtagatatcatctaagagcttatataagtactggataatggacaatgggtgaccatctaaaaaataaccacgacattttgttgattgtaactgtaaattatattctttctctgctaactcacttcttaattcgtttaaatcgtttaagatagtatttcgagaaacatcgtttagttgcatcaacctatcaatcgttacgcggtccttagctactacgatagatactaaagacagctgcaacctctcactacttttcatgacgtaactataatcagtcacttcatctaataaaagacgacaggctgctttttgtttttctgttagcaagattcctacacgtggataactaacaatctgaggcacatcgctaggcagtgcatcgtttatcttctctaagtgataatacactttacgtctagactgattaagtgcgttggcaattgccataactgtttcaggttcctctaatttcaataggtaaaagaggaggtcataactttttttatcgagaataatcaagaatatacctcttttctactcgaattcatacagacttattataacatctttttaaagccttttcattaaaagttttgactattactgatagagattaaacgttgaacatccctttttaatatctccaactctgtggggtattctagagctagatactcacaattagagaaactctttaacaaatcagtcagattaatctctccttcgaagaggctcttcgagaggtggggctttccagctacctgtataaaatttttacagtgaaggtaggtggtatcacaagctaagttatttaccgcttggtataggtcttggttgataaaggcccaattagcagtatcaaaaacaaaacttattggtatttgtaattctttcactagagtcataaaatattggcaattctccactgtagctgctttagggtcttgattattttccacctttataccaatagtttggcttttcaatatctctttaagaggttctaactcttctttacttaagtttctggtttgtccaacatttagcttaatgaaaggagctcctaactgtgatgcttctttaaggcctttattaagataaggattaactttccctcctttgataaggtcttcattagcactatagtaaagattgatatcataaaagtcagcctctgcttttaaagcgggtagctctctatctggatcttgaagcaattcttgacgtatctcaaatcgtgaaaatcctaaatcctttactaacttaatgagctgaacttgtgtaaaacctttgtctaactgttttttgaatacaatactattgataataatatcttcttgtttcataacaactcctttgatatccctacttattcagatgaccgagttccgaccaaataggatccagtgtttctaataatttttggtaagcgtgatatttttttttgtacccctttacttcggataattgaggtttataaatagcttttacacgaaccatatcttggactgcttcctttaacgaaatcttatctaaagcatgacgtgctaaaatagctcctcctaaccctcctaattctgtgccttctactgtttcaataggaaagtttaagatatcagaaaacatttgcatccatgctggtgagttggtagctccgccagagaaacgaattatttttggcacactgcccctactttttattaaatcagtgatatgctgcttatgtgcaaacgcaataccttcatataccgcacgtatcatctgagatttcgtcgatttagttgttagcccaaaaaagcaagcgctagcatcttgtgatgtgttactaccgtaaagaaacggaaagaaaataagtccatgatgtgtagcatcagtatgagtgagaaattcttctaaattatcatagatagaacctccactagatttagcgttatcaatttcttgatgcatgagcatttttaacataaaattaagattccctgcagaagtagggctacttgcctctaagagataacgacgatctggaaaataggaagtcataagaccactatcttgctttgctggttttaaacttggatatgtattaatattccaagttcccgaaataacactaaaagtatctgactctaaaacacctgatccaagagcacaagcatcgatgtcaaagagccctccaacaacgggggtcccttctacaagaccagtctcttttgctgcttgagaactaattcccccaggaactaaatctgcactatctataagttcaggaagtgagttttctatctctctaatgccaaaaaaatctaaaatagctggatcataagttcctgtttggaaatttatccaatgattacctgaagcgtcaccatattcttgctgtacttttcctgtaagcttataccgaataaagtcctttgcagaaaggaccgcccctattgatttataggtttcgggctgataatctttaagccaacgtaaaataactggactttgtgaagggaaaatatgttgccgagtcaactcccaaatattatcaagtttagattcgaaatattgcgccaaatctttggcacgattatctgtagacaaaattccttgttcaagtggctccaacttattatctagcagataaagacctttcccatgtccaatacatgctactgcactaatctgctcagggctgagttttgagatttgaataacctctctaatagcagaagttatagcattccacgttttaacaaggtttacttgacgatgaccagattgagtctcattttttaaagtttcaaaactcgaaacagcgatttggtgtcctaatttgtcaaaaataagcgccttggtatttgtaccgccgtagtcaatactaaggtaataagtcataatttgtctcctcattgttgatttaaaaaggaggtacaagaaactcttgtaccttgaaaactcttctaatagagattgagctctttggttgtatcatctatacctgctctgttagcctttacatgttcttctttaaagtaaacacgctcagcattattgtacataacatcttctagttcctcttgactgaaaatatcaacattctctagccaagtagctaattcttcgtaagtattgaaggtcgctgaccatggagaatcagttccccaaatgatacgcttagccccaagaacttctttagcaatacgtacattttgttctgattttggaaaaggaaaactatctggggcatcaatatcttgaatagctgaaatatcagtatagatattgttgaagtttttccacatattaagttcagcacgcaatcgatttgaatgctcaacatgtggaaaagagaggtgacaaacaacaaaatcgagactcgtataaaggcgagctaaattagcaatagcatcaggttggtgactaatttgatcccaattgccataatcaactgtaactacaaatcctggatagtctaacagataagtcaaaatacgactcacatgtgggtctgtatcaagacggaaaggcgttttttgtccacggtatccatggataccccctccttgactaatttcaaatttaatagctcgaaaaccaaggacttcaacatgacgttttacaatttgcattgcgttatctgcaaatggatcaacagagaatgcgcctgtaaaacgttctggataacgtttaatagctaaatgcgtataataattttgataaccattaagatgaccttgcaaaatgactgctttatctacaccattagcatccatatacttcaaaaaagcttcagctgtaaatgctttgtcaccgtattcgtctgggatgagcttaattaaatcaccatcatcccaaatagcataaccgtttccaagggcattaagacgtcctttaccattaaatcctgcaattgtatcaacaatatgagcatgtccatcaatttttttcatgagtattcctccaacagatttttaatcttcagcaataaagattttttcacaactaccttcatatccgctattcttatcagccatagttttaaggtatgcgtaaatagattcacgatgagtacgaagcaagaacaagaaagcaagatagataacaactgtcacaccaatatagagtgggttcccagatatccaagcaaagaagactagagctgtcaaaggatgagctaggagattaaagctcataatcaaagttacccctgctggtaaagcagttccaaaatgcttaacagcttctgtgtagattggacctagggcactagcagcataaagacctagtgaaaaccatatgattccattcaaaatagctttaagaatatttccttttgacacagctatcatagcttcaatcataaaagggatagcaataaggtcaacgactggtaaagcttcatttccaggtaaaatcaaggaaataacaaccattattggtactaaaatgagacctgcgataatagttgctggttcaccaaaaccaacaccgtcatcaactgcaataaaccaacgttttttatccagtgctccttgctcagcttgactttcttttttcttattgcgttcaactgcttcagcaagaggagcaaaagcactagcaaatacccccgtaatcaaaggaaaaatagtcataaccgctgcaagagcaactgcaaaaccaagtatacctccccaagtatcaatacttgcaaggttacgtaaactacctaatacaccaataatcacaccaagtataaaaccaagtgtcattggctcaccaaatatccctaacttagtctttaatgattctgggttcaactttaccttattgacaccaagtaggttccaaagaggatcaagaataagagctggaataagggtttcaatattatgaatcgagttgatcgttgcatttttaacaccgtaatactccgaccatcgatctgccaatacttctgacatcactaatgaatagagtaagacaaaaaccataaatgcgaaagacaatataaaattacctgttgctgcataggccattgtaccccaaatcatatagccaaagttattccaaagattagatgggacaaatactcgggtaatcccaagcaagaaaagccccaattcaattagcaagccaaaaacaaagaaagagaggccaatctcagaagaaaaggcggtgagagaaccagcctgccaaccaatatctacaattggtaaatggagaccagtagttttaaccatctgctggatatacttagtcaccataggagcaaaagctgatataatccaaccaaagcctgtgagtccaacaccagctcgtaaggcgctaaagaaagctcgccttggattgacctttagaaaaaggctgacaataaaaatcatagcgggtacaacagttgctgcaccaaagacttcaaagaatttatgtaaagcttctagcataagttcacctttattaaattattaagcgcttacatttactcgtaaaaaaatgggaggtcccattttttcaaaagatggctctgcgctcactagccaattatttattgacaatattttgtggcttgccatcaaagaaggcaatgatgttgtcagctgcttcttcagccaaagttctacgtccctcaatagtacctgtcccagcatgtggactcatgataacattatcaaggcttctcaatccttcagatacctgtggttcattctcaaaaacatctaatcccgcacccgcgatttcaccttctttcagtgcttcaataagtgcttcttcagaaacgattgggcctctagcagcgttgattaagtagcttcgatttttcatcttagcaaaaacatctttattgaatttgtggattgttgatggtaatgctggggcgtggatggttatgacatcagctgttttaataagctgatcaaattcgagataggttacaccaagctctttttccttatcttcaggaagtcgataaacatcattgtaaacaacagtcatcccaaatgctttagcaaaatttgcgactgtcaaaccgatgcgtcccattccgtaaatacctaatgttgaaccttgcaaagtcaaaccttgataacgttgttcgctcggatcaatccactctccacttcttacaatactatcataaaatgcaaggcgcttactggcagctaaaattaaagcaaaagtcatttccgctgtcggaactcgtactgcttgaggggaattagagactataattcctttttctttagcatacgcagtatctacatgatcaaaaccaaccgcatttaaagaaataatttgtaagttttcacctgcatcaatcatctctttatcgcctttttgtcccatgagtaaccatccgtcatattcagataaatgctctaacacatagtcacgtgaaaatgggcgatcttctgaataagtaacatcaaatcggtccataagctttcttagaccttctttaggcacaatacccgttactaagatttttttcttgtccatattgtctccttcttaaatttattttactaattgataaagagcaacttcgccacgtccgttattggctgagaaaagataagcttttccatctttttcaaaagctaagacattactagaagctgcttttgcatctactaattctgaaaccaagtgcccatctacaaagtgaaaaagccttaattctgctttttctgatcgccacccgaatacaaaacaagtctgattaagtaaacgaccactccaaatagcatgaccaaatggtgttttttctggataatggaataattctcgaccgaaatcttcagtgaagatgcgtaaacgatctccatgaaaaccttggataatcacatactcatccttgccatcctgattaatatccactttcaccacatcgcttgtctcctcatcgaaaagccgttctaattgccagtcgcctgtagtagaaaattctggataagtgagtttgaataccccttctactgaagtaatcaatgaatatccttcatcctgaatggcatagtatccatgattttttaataaagtttgaggcaattgttgcaatccttccaatgtatggttttgagtattaaaacgagcaacaaaaattcggcctttatcactccaatcctcagtgtgggctttactgttagcaattgtacaacctataaagtaaagttgattttctttacctttaatgagatcaaagcgatgtaaatacggaaaatcaaatgcgttacaaatgtcccaatgatctccttgaaaacttgcataaacaacctgacaatctttggccttaaaccctgggtaaaatttctgggttgccaaaaaatccatggttccgggaattggaataatactcatggtacctcccacatcttcccaaacaacaatttttgctaaatcgctattcaaatcataagcaaagcaggcttggtcaacctctgaagctactaataaaaaatcatagtcttgattttgcaaacgacaaactgaataacaagcttcaagtctgtctgacaataatttattaatcttcattctatcctcctttggtgaagataaaacttgagttaaccgtttaactaatggtgcaaaaaaataaaaacatttgagttaagagagttagagatggttcgttaaaagcttacctattcttaagttaaacggttaactcatttataattctattatactatcattttctataaaagcaagcgtttacatagtgttttttgcttttttataaaaaaatgcttgctctcgcaaacatttttaaaaagattgacgaataacgatttgattttttacttctagtaaccttgcagtagttggttcgtttccttgactaattttttcaattaaacattgggcagccaggcaaccaatgccatatgaatcctgttttatacaggaaacgtttggtgtaagcacctgcatccattctaaatcttcataactcccaagaccataatcctcagggtagctgaccgttgattgatttaattttttcataaaattcaaaagagttggaccgttcatcattaagaaccctggtttttgctctgaatgttcaatgatatcaagaattctctgtgtactaccatcttcagtgataataatcaacttatcaggatttgaactgaccacttctttaaaaccttcgtaacgaagctcacgggttgaaatcccttcaatgggataagtgacaaaatagatgtcatgatacccagcttcttgcattttttcaagaaatatttgagtcgattctttattgtcggatgctacagtatctactttaatatctttagcttgtctatcaaccatgacaagacgatcattactcaaagtttctataaatgaatgattaggatctacagaatctaaaataattcctgaaacgttttgctgatttaaacggtttaaattttccaactcaatgtcaatatcattatccgagttagtaaagttaaccgagtaaccaaattgttgacaagtatcatgtattcccttcatcacagacgaaataaagggattagtaatatcagcaataacgaccccaatagtacgggtattttttgtaactaaactttgagcaatcttacttggttgataaccagtctccttaatagctaaacgtattttttctttcgtttgcagagacattttcttatagttcccattgagataataggaaactgtagcttttgacacacctactaaatttgcaatatcactaatggttaccttctcaaacatctctatttccttattctaattagacttaatttatccgtattatatcatttaataagaaaaatgaaaataagtgttcttattggagaagattataaaaaaagacaaacccattatcaaagtttgtcttgcactagtataattaagagtttgctttatcgtaacactacttcttcttgaaactatcccaatcttttaagaaagtttcaatccctttatcagtaagcgggtgagtaaatagtgatgcaaatgttttatctggaatagtggcaatgtgcgcaccgcatttagcgacgccctccacatgcgccaatccacgaatgctagcagcaataatctcagattggaaaccataaaaatcaataatgtgacgaaggtcacgaatcaaagcataagcatctgttccaatatcttcaagacgacccacaaaaggactaataaatgttgcaccagctttcattgccgaaagaccttgagccacagtaaatattaatgtcacatttgtctttataccttcttttgataattgtgaaactgctgctaaaccttcttcagtcattggaattttaacaacaacatttggtgaccacttagcgatttctctagcttcggtaaccatttcatcacaagttaaacctgtcacttctgcactaactgggccatcaacgatttggcaaatttcgttaataacttctttaaagtcacgcccctcacgtgaaataatagtcggattggtagtaacaccatcaacgattcctaaacgattaagacgacgaatttcagaaacatcggcagtatctaaaaagtatttcatattattctccttaatgttcttgtcctttttgaccataataagcatttggtccatgcttacgtaaatagtgtttatccataatatattttggagctggttcaacacgtggattaatttgttcagtgaaacgattcatcttagcaacttcttcaagaacgactgagtgataaactgcttgtgctggatctttcccccaagtaaatggtccatgattacgtacaacaataccaggaacagccattggatctaaatcccgacgttcaaattcctctataataacgctacctgtttctttttcataagcagtgttaacttcatcttcactaagtgacctagcacatggtactggcccataaaaataatctgcatgtgttgttccataaaatggaatatcgcgacccgcttgtgcccaaccaactgcttctgttgaatgagtatgaacaataccaccgacttctggccatgctttataaagttgaacatgagttggaagatcagatgatggattcaaatccccctccactatatttccctctaagtctgtgacaaccatattttcaggtgtcaattggtcatagtcaactcctgaaggtttgataacaatcaatcctgcttcgcggtcaacttcagaaacgttaccccaagtaaatttaactaaactatgaactggtagtgatttattagcttcacacacacgttcacgcatttcttgcaatgattttgccatattatttcactcctgttttctccattaatgggtaaagaaaatcttgcgcctctttaatggctgcacgtgtttcctctacagtctcacagttctccgaccacatttcaatcaagaatggaccattataatttgttttcttaatgacagcaaacatttcttcccaatcaacacacccttgaccaaatggaacatcacggaattgacctttagacgtttcggtaacagcataagtatctttaatatgaagcgctgcaattgagcgatgtccattataaaattcactccaaagatcattatgccatgctgatacatttccagtatctgggtagacaaagagataaggagaatcaatctctttttccacagccaaatatttctcaatggaattcataaatggatcatccataatctcaatagatagaataacttgtgcttcttcggcccaagtacaagcttgacgaagattcttaataaagcgtgcacgtgtctctggagatttttcttcatagtacacatcatatcctgctaattgaatattacgaataccaatatcttgagcaaagacgatacattttttcatcatatccatcgcacgcgcttctttctcaggattattagatcccattgggaaacgacgatgaccactaaatgtaattgttggaacacgaactcctgtctcaaaaatagctttgaccaactcaagtcgttcttcttttgaccactccaaacgtgccaaacgttcatctgactcatcaatggataattctacaaaatcaaatcccaattctttagcaaattgtaggcgttctaaccagttaaaatgttttggtgttgccttctcgtaaattcctattggacgtgtcatatattacccccaaatacgtttaatttcatccttaaatgcacgtgctgctgcggctggatcatctgcctctgtaataccacgacccgcaataaaagtaaagacatcaacaccttcaaataattgaagagtatcagttgataaaccaccagttacagaaactcggaagcccatatcaatcaattttttaaccttattaaggtctttctctccccatgtttcgccagcaagaagcgcatcacgagattggtgataaatggcttgtgaaatacctgcatccaaccattgttgcgcttgctcataagtccaatcaccatatagttcgatttgaatttctccacgatcgccgcgttcttctttgatagcttttaaggctgcttccattgttggaatagtagcacaacagatacaagtcatccagtctgcaccgcgaacagcattatttttagcaacagtcccaccagcatcagcacattttgtatcagcaacaattattttgtcagggaagagactgcgaaggacctcaactaattcactacctacttgaagaaggcaaacagttccagcttcaataacatcaacttcatgtcctactgatacggcagctttgatagctccttgtaaatctgagtggtcaagtgcaacttgtaaatttggtaaacgttttgtcatgttgtttattctaaggacctgataaaaatactcattttatttgtggcaaagagtttcttatcacagagattttttataggtcctatcctttctattaatatcagtttattgattagctttctaaatctaaaccttctaaatatgggctgttttttgattcctctaccattgcaaggacttcttttgcttcttggcattccgtcaagcgctgaattgaattttccaattcaaaaagggcaataatttgagggatagcaacagaagtatgaatagctgaacttgttgcagcaagtgctaacaatactgagacttctttgccatctggaaaaactactggctctgttaatgtaattaatgaaaatgcatcacgttttacgcctgcttctggacgagcatgaggcatcgccatacccggcataagaatgtagtacggaccaaattcctctgtagattcaataatggcatcgtaatattctgcatcaacagcaccactttcaatcaatggatcaattgataatttgattgcttctttccaatcgcttgcagataatttaagacgaattgagtcattttcgataaaggcttgttttaaattcatgatttctccttaaaagtctaaagatatgggagagaaacttttgtctcactccctttgtctattaacttacaaaatttcttgtagttttgtttttatttcattgtcatccataaggttatcaagacctactaaatgaccttttgtacgtccgtctaattcatggataaggtggtttgaagcaaccacgatatcgtagtttgcagctaaaccttttgcttctccgactgagcaagatgctgactcaaagttgctaacgcctaattgacgaagcgcattttcgactttcattttgataaccattgatgatcccatgccgtttccgcatgctgtaagaactttaaccatttttatttcctccgttataaatttctattattctgcaggcgcatcaccacgatagtatgcttctttatctttagatttcataaattgaagttgtggaatagctaagaagaagagacatacaatcacgtaaccagcgatacctaaatacttgaagatgtaaccaaatgctaaccatgggaattcaaagtcgatatttccatgataaccacctgcaagtcctaaaagacctacagcaacagcaccaagtgccacctgaataatacctgagataaatgatagagctactgctgctttccagccaccacgtttatctgcataaacagcgattgccgcattatcaaagaatactggaacgaatcctgtgataatcaagattggatttttgaagacaacaagtagagcgattgtaattaattgaccaatcaaaccaaaagcaaatcctgaaagaactgcatttgaagaaccaaaaccatatgaagctgcaacgtcaactgctgggaatgatcctggaagaagtttgtttgagataccttggaaggcatttgtcaattctgtaacgaacatgcgtacaccttgcatcaaaatgaaaaggtaaactgagaatgtcaatgatgtttgaaggatgtacatgaagaaagcttgcttagttggtacaaatgcaccaggtccgattaatttaacattagacataatgtctggaccaaggacagctaagattcctccaaagaaaactagcatcaatgttgctgatgcaacaactgtatcatggaaaatatttaagaatgttggtaattttaagttatcaaggttttcttcttttttaccgaagaatggcgcaactttatcaacaaaccaaattgcaaattgttgttggtgtccgatggcaaatccgccaccacctgtaaggcgttgagttgcttcaacggtcatattagaacttaccgcccaatatagaccacaaatgataccaacagcccatgcaccaaaaccattacgaagttgtggaatcaagagcagtacaaatactgaaattgttgcagcttgttgtaccatgatatgaccagtaataaaaagagtacggactttagttactttacgaagagcaaccaagagaatgttaatcccaaaaccaatcaagagtgctgttgttgcaacactgataaagcccattgtttctaacttagcatttgctgatgctaaaccaaagtaagggtcaataacagcagcttctaaattaaattttttagcaagagcaactaagattggacggaatgtattaaccaatcctcctgcacctacgttcaaaatcaaatatccaacggtcgctttgataaaaccagcaaagacatcatgaagtggtttcttcaataaaagatacccaatgagtaccaatagacctacgaagaaggctggattctgcaagatattttgcgagaaccaattaaggggagctaggaagttttccataactaaagacctctctttatttaagtaatgtttttttgtatctttattatattttttgtaagcgttttaaaaaagaccaagaagtacacacttaagtgtgcaaaattgtgctgaacctaatttacaaaaaaatcatgtatcttaggatacatgtttttttatattttttaatgtagactcctaatgatttctacacgcgtcacaagaccatcgtgcatactatcaacacgcaatgcaacgttattaatatagactactgaaccaatagcaacgtccttttcctcatcatttaaatgacgaacaagtaagtctcctaaagtttcattgggttgacaaggtagttgaaccctagctaaaatattagcttttttgactttgttattagcacgtaaaacaatgttgcttgacccatcaaaatgggtgaaaagatatttacgaacagcaaacaaaatagcaactgaagcaatccccataaggtaatctgaaacactaccatgttcaattacaagttgacgagctaaggcaaacaataacacttcaattaaagtatctggggaaggttttgaaaacattttgatcaactcaatcccgactgctattgtcatggcgcgagcaaggaaagtctggaacaacttatcaacattttgatcaacagacaacatgctaaacaaatcatgaaagagtgctaaactaaaaaaaataatagctgttgccagaataactgacaaagcaatctctaaataataagccacctctacaataacatcttggaaaaatttacgcatacaatctcctcttttataaactaataacattataacatttcgtcgttaaagttactaattcaatgaaacaatagtgaccaccccttcattaaccttttaatcagtactaacgaatgtttgattacacattatgatataataagcttattggtaaataagtgggaggaaatgaaatattaattaataaacggttaagaacaatctccttactacattatctgttagcgctactacttcttatagacattatctttacgattgattttataattcacacgtcaacaatttccaaaaatagtctatcatatataagttatggtcaaggatttggttggtctatgattcttattaatttgatagctctacctatttgtttcctagtagaattgtcagctggtctactattaaaattagaaatgcataagcaacatggctactatcctctggaacgcttattgatgactggtaatattctaacagttgtatcgctagtattattacatactttgattcacaatatcaattcacttctttttttatcaattacagtagttttattgatttctgggaagtccttaagtcttattagtatctatctattaaaaagaaaaagtaaacatcaaaaagtctgactgtacagtcagacttttaatattaaatatttgaccaaacagactcaagaatgtttgtttgttcacgaccaggccctactgagaaagtagaaatacgaacaccaaccaattcgccaacacggcgaacgtaattacgtgcattttctggaagatcatctaagctacggcaagctgtaatatcttcagaccagcccggtaattcttcatagattggtttacaacgttttagctgttcaaggcttgctggataatagtcaatacgtttcccatcaaggtcataagccacacaaattttcaccgtatcaagccctgaaagaacatcaattgaattcagagagagattagtaatacctgatactcgacggctgtgacgcataacaacagaatcaaaccatccaacgcgacgaggacgaccagtcgttgtaccatactctttaccaatctcacgaatacggtcaccaacctcatcaaaaagttctgttgggaatggtccatcaccgacacggctagtgtaagctttacatacacctactactttattaattttacttggtccaactcccgaaccaattgtgacaccacctgctactggattggaagatgttacaaatgggtatgttccttgatcaatgtcgagcataactccttgtgctccttcaaaaagaacacgtttaccggcatcaagagcatcatttaagataacggatgtatcagtcacatattgcttaatttgttgaccatattcataatattcttcgaaaatatcatcaaattcaagaggtgtactgtcatacattttttcaaataaacgatttttctcagctaaattaattttcaaacgctcagcaaaaacttctctatcaagaaggtcagcaatacggataccgacacgcgcagccttgtccatgtaagctggcccaattcctttgatggttgttccaattttattatcacctttagcatcttcttgtagttggtcaagcttgatgtggtatggcaagataacatgcgcacggtctgaaatacgaaggttatccgttgttacaccttctccgtgaagataagctaactctttaactaatgatttcggattaacgacaacaccattaccaatgacagaaattttttctttgaagaaaattcctgaaggaattaaatgaagtttaaattttttgttatcaataacgatagtatgcccagcgttatcaccaccttgataacgtgcaattacttctgcgtcagcagataaaaaatctgtaattttacctttaccttcgtcaccccattgggtacctactacaacaactgaagtcatatttatttaacactgagtgagcctttttgggactccccaatcctttctggaaaaacatggcaggaatttcacctgcgagtttgtctgacaccttattatagcaaaaaatgtttttttttgccaaattcctcaaatattatcggaaaaaaagaaaaaaataattattagaagtgtaaaaaaacggtaaaaaactaacattatagttgataaagaaatcttgaaatttactgataccagcattcttaacaataaaaaattcaacgatctttttattagagtcgttgaattttaaattatcaagaacagttatcacaagtcagatatcatatctatattaatgatatttactattagcttttcatgaagtaactagttatctctagcctgtagctcttcttttgtaactaatttataatctttaaaaacaatgcctccaaaatagcctgctagtaaagataggataatacaacctagagcggttattagtacttttatcattgggttataggcaaacatgacagcaaatcctgcaattggtgtcgctgttccaggagtatcattaactaatttcatcaaggcaattaaaataccacaagctgcaccaccaacaaaattagtgacatagattggaatagggttagctgaagtcacgtcagcttgagttagaggctcaacagcaaaagctatattatctttacgacttccaagttttaatttatggaaaagtacaccattcataaatgacgaaccaaagacagacaaggctcctatagccataggcattccggttaatcctagcatagctgtcaatgccatagaagaaagtggtgctgtcgccactactacaattgtcccgccaagtataatccccattaaaatagggttgctatgagcacctgatgttaagatatctccaatggtgagcaaagtgctattaataagcggcgtcaacagtttggccacaagacgtgttaatggtgcaccaataataataattgaaataagatctaaaccaccaggaatatttctttccatccacttaacaagaaatcccactaaatatcctgcaaggaaaccaggaataatacctgttccagaaacagataaaccaattaaaactgcgtatcctggggttacaccaatagcaatagcaaccaatatagctgcagctacaccagaaagtgaaccattagcaccacccacttcacttaaaaattgaaatcccaaaactttaccaaagaaagaatcttgaaaagcttctacaaggaaggatgcacaagccgcagatgccaatgctcccattgcttttgttccgtagggtgctttataattaaataaagtgaaaatcgctaatacaagtattaaaagactggtcccaataatgatattcataaatatactcccgctaaaaatagttaagttttttattctcagtgtctgtgtactactgcttcaatttcaataaaggcgcctttaggtaatactgaaacttaattgtactacgaactggataaggtgcaacaaagaagtccgacataattattaggcttatctcatggattactccttagttgctaatataatcacattttacctaaaagcataaccatagtcaataataattttttattttattaacttttttttattacgataattttttattacattaatcttttaaaatagtctgatattgtcttttaaccataaatatattactataatagtaagattagcatagaggaactacgatatggataaagaaaaattagactattggaaaacgataataacgtttctccataatgttttaggtgataattacgaaattgttttgcatgtagtagatgaaaatgatatctatattggtgagttggttaatagtcacattagtggacgaaccataagttcacctctaacgactttcgcccttgatttaatcaagaataaagtttataaggaaaaagattttgttactaactataaggcgattgtcagccctctcaataaagaagttcgtggatctactttcttcatcaagaatgctcaaaatgaacttgaagggatgttatgtatcaaccttgatatttctgcataccaaaatattgctttggatattctagacttagttaatttaaatgttaacaaaatactacctaagtcccctcaaaaaatttctctccctcaacaggaggaacctgtagaagttctatcaggcaatattcaggatattattagtgagattgttgatcctagtcttttaaatcagaatattcatttaagtcaagaagttaaggtagaaattgtttctaaacttcacgaaaaaggtgtattccaattaaaaggtgccgtttcaaaggtcgctgaagttctcaacatctccgaaccaagcgtctatcgttatcttaaaaaaattgaaactcattaactctaaaactctttttaacttatagattaataagattggactcaaaagttcaatcttttattttttatgacaccggtataagattattttagttttctgtgccgtaaaacttagtttttattatttttttgataaactagtatcatctgttactaggaggaatgttgtcgtgattatcgatcgactgttacaaagaagccactctcatctaccgattctacaagctacatttggcttagagagagaaagccttcgtattcaccaacccactcaaagggttgctcaaacaccccatcccaaaacattagggagtcgtaactatcatccttatatccaaacggattatagtgaacctcaattagaactcattacacctattgcaaaggatagccaagaagccattcgatttttgaaagctataagtgatgttgctggacgctctatcaaccacgatgaatacttatggccgctttctatgccacccaaagtgagggaagaagacatacagattgcccaattagaggatgcttttgaatatgattatcgcaaatatttggagaagacttatggaaaactaatacaatccatctctggaattcactataatctcggtttaggtcaagagttattaacttctctctttgaattgagtcaagcagataatgctattgattttcagaaccagctttacatgaaattgtctcaaaattttttacgttaccgttggttactaacttatctatacggagcgagcccagtagctgaagaagactttttagatcagaaactgaataaccctgtccggtcacttagaaatagtcacttaggttatgtgaatcataaagatattcgtatttcttatactagcttgaaggattatgtcaacgatctagaaaatgctgtaaaaagtgggcaattgattgctgagaaagaattttattcacctgttcgtctccgtggtagtaaggcctgtcgtaattatttagaaaaaggaattacatatttagagtttcgcacttttgatctcaacccatttagcccaatcggtataacgcaggaaactgttgatactgttcaccttttcttattggcgcttttgtggatagattctagtagtcatattgaccaagatatcaaggaagccaatagattaaatgaccttatagcacttagtcatccattagaaaaattacctaatcaagcaccagtttctgacttagtggatgctatgcaatctgttatccaacattttaacttatcaccttactatcaagacctattggaatctgtaaaaaggcaaattcagtcacctgaattaacggtagctggtcaacttttagaaatgattgaaggactttccttagaaacatttggacaaagacaaggacaaatttatcacgattatgcttgggaagctccctacgccttaaagggatatgaaacgatggaactttctacccaattgctactatttgacgttatccaaaaaggagtcaacttcgaagtgctggatgaacaagatcaattcctaaaattatggcacaatagtcatattgagtacgttaaaaatggtaatatgacctcaaaagataactatattgtaccgctcgctatggctaacaaagttgttacaaaaaaaatcctagatgaaaagcatttcccaactccttttggagatgaatttactgaccgtaaagaggcacttaactatttttcacaaatccaagataaaccaatcgtcgttaagccaaaatctacaaactttggtttaggcatttctatttttaaaacatcagctaacttagcttcttatgaaaaagcaattgacatcgcttttaccgaagatagtgctattcttgtggaagaatatattgagggtaccgaataccgtttcttcgtccttgagggggactgtattgctgtattgcttagggtagcagctaatgtcgttggagatggtattcatactattagtcagctagttaaacttaaaaaccaaaaccctctcagaggctatgatcatcgctctcctctagaggttattgagctcggagaagtagaacagttaatgttggaacaacaaggatacactgttaacagtatccctccagaaggaacaaaaatagaacttcgccgtaattctaatatttccactggcggtgactctatagatgtaacaaatacaatggatcctacatataaacaactagcagctgagatggcagaggctatgggggcttgggtttgtggagttgatttaattattcctaatgccactcaagcatactcaaaagataagaaaaatgctacttgcattgaactaaactttaacccattgatgtatatgcacacctactgtcaagaggggcctggtcaatctattacacctcgaattttggctaaactgttcccagaattataactaaaaagagttccttaggctaagcttaaggaatttttggttaaaataaagttatcccttgtcatcactagttcatttaagataaaatattaacaactacagaaagttaggttaaatattattatggttaaaaaacgctattccaaaaattctcataatctaataacattacttggtattgttgttcttgcttccctgatttcagacttttggagtgaggtgattgctactctgttaattattggtggtggttattgtgcctattacgtttatgataaaaagcgtcttaaacgttttacatcaaaccaacgtattgaagctttaaaatccgatattaaagagactgaccaagacattagacacttggaaattttaaaaaaagacaatcgttctaaggaatatatcaaattagcacatcaaatattacctcaattggacctaattcgtaatgaagcaaaccaactacaaaaagccattgagcctaatatctataaacgtatcaccaaaaaagcaaatacatttagtaatgagattaacgaacaactaataaagctacatgcctctccagaactagaacctatttctgatcaggaagatgaaatgatacgcattgctccggaattaaaaccgttctatcacaatattcaagatgaccactttgctatcttaaaaaagattgaagaggcagataacaaagctgaattagcagcaattcatcaagccaatatgaaacgttttacagatgttctggctggctacatcagaatcaaacaatctcctaaaaattttaacaatgctaaggaacgcctagaacaagcattacaagcaattaaaaaatttaatttagatttagatgaaacgctgcgccaattgaatgaaagtgatatgaaagattttgacgttagcctaagaatgatgcaaggcgaaaggaacagtaaatgagcgatacctttaattttgatattgaccaaattgcagacaatgctatcactaaaacagataaaacaacagaaattatttccaaccagacaacaagccaaactgggcaaattgccttttttgaaaaactaacaccagcacaaaagtctgctatctctgaaaaaacaccagctttggtagatacttttgtcggcgatcaaaatgcgctccttgattttggacaatccgcagtagaaggcgttaataccactgttaatcatatcttgtctgagcagaaaaaaattcaaattcctcaagttgatgatttactaaaaaatgctaatcgcgaactaaatggatttattgccaaatataaagatgctactccggcagaattagagaaaaaaccaaacttgattcaaaaattattcaaacaaagcaagacctcgctacaggaattttattttgactcacaaaacatcgagcaaaaaatggatatgatggcagcgaatgttgtcaaacaagaagatactttggcaagaaatatcgtctctgctgaaatgctcattgaagataatactaaatctattgaaaatttggttggagttattgcttttattgaatcgagtcaagccgaggctgctaatcgtgcaagccacttacaacaagaaattctagcattagatagccaaacgtccgagtatcaaattaaaagtaaccaattagctcgaatgactgaagttatcaataccctcgaacagcaacatcctgaatatgtcagccgtctctacgttgcatgggcaacaacaccacagatgcgaaacttggtcaaagtatcgtcagatatgcgtcagaaacttggcatgttacgtcgaaataccattccaacaatgaaactctcaatcgctcagttaggcatgatgcaacaatctgtcaaatccggtgtcactgctgatgctattgtcaacgctaataatgcagcattgcagatgctggctgaaactagtaaagaagcgattccgatgttagagaagaccgcacaaagccccactgtttctattaaatctgtcactgcattagctgaaagcttagtggctcaaaataatggtattatcgctgccatagacaaaggacgtaaggaacgtgcccaattggaatctgctgttattaaatcggctgaaacaatcaatgattctgtcaaaattcgtgataaaaaaatagttgaagccttactcaacgaaggtaaatctacccaagaaaaagttgatgagtcttaacttactatcatatccactaaataaaaacgatactgtaaaacacagtatcgtttttatatcattaatttataccgttttcatctatattttcctgactatctccaatgcaaaataagccttttatgctataatatgacttatggataaaattataaaatcaatttcaacttccggttctttccgggcttatgtccttgattgtacagaaactgtaagaacagctcaagaaaaacatcagacactttcaagttctactgtagctcttgggagaacattaattgcaaatcaaattttagcagcaaatcaaaaaggaaatagtaaagtaactgtcaaggttattggagatagctcttttggtcatattatttctgtagctgatactaaaggaaatgttaaaggttacatccaaaatacgggtgttgatatcaagaaaacagctactggagaggtcttagttggacctttcatgggtaatggacactttgtcgttattaccgattacgcaactgggcaaccttacacttcaacaactccactaattacaggagaaattggagaagattttgcttattatttaaccgaaagtgagcaaacaccttctgccgtcggtttaaatgtcctcttagatgacgaggataaggttaaagttgcaggtggattcatgcttcaggtgctcccaggtgcttctgacgaagaaatttctcgctatgaaaaacgcattcaggagatgccttctatttcaagtctgctagagtctgaaaatcatatagaatctctcctttcagctatttacggagaagacgactacaagcgcttatcggaagactctttagccttctactgtgactgttcaaaagaacgttttgaagccgctctattgactttaggaactaaagaattgcaagccatgaaggatgaagataaaggtgttgaaattacttgtcaattttgcaaccagacttactatttcacagaagaagatttggagaagataattaatgactcaattaaatagttcatttatgattgggaaggttgaaattcctcatcgtaccgtactagcaccgatggcaggtattaccaattctgcttttcgtactatcgctaaagaatttggtgctggtctcgttgttatggaaatgatttctgagaaagggttactttataacaacgaaaagaccttacatatgctccatatcgatgaaaatgaacatcctatgtcaattcaactatttggtggcgatgcagaaggcttaaaacgtgcagctgactttatccaaagtaatacgaaagcagatatcgtagacatcaatatgggatgtccagttaacaaagttgttaaaaacgaagctggagctaaatggttacgtgaccctgaaaaaatttatcatattgttaaagaggtaacgtctgtacttgacattccattaacagtaaaaatgcgtacaggatggtctgactcatctaatgctatagaaaatgcactcgctgccgaatctgctggtgtatctgcacttgctatgcacggtcgaacgcgtgaacaaatgtatactggcacgtgtgaccatgaaacacttggcaaggtcgctaaagctgttactagtattccttttattgctaatggtgacattcgtactgttcacgatgccaaatttatgattgaagagattggagctgacgctataatggttggacgtggtgctcgtagcaatccttacatctttacacaaattaatcatttctttgaaacaggcgaaatccttcctgacctaccatttgagaagatgttagatgttgccgaggatcatctcactcgactagttaatttaaaaggtgaaactattgccgttcgtgaatttcgagggttagcacctcattatctgcgtggaaaatcaggcgcagcaaaaattagaggagctgtttcacgtgcagaaacactagcagaagttcaagaactttttgcaggtttacgctaaatcaaaaacagtcctttgactgttttttcctatctctgtacaaatttagcataaatcattgtgtaatgaaaactcaaaagtataacaaattattttagcataacagaattaaggagaattatgttgattgttttagctggaaccattggagcaggtaaaagctcccttgcagctgctctaggacaacacctagggacagatgttttctatgaggcggttgataataacccagttttagatctttactatcaagatccccaaaaatatgcttttttactacaaatattctttttaaataaacgattccaatctataaaagaagcctataaggctaacaacaatgttttggatcgttctatttttgaagatgaactattcctcactctaaattataagaatggaaatgtgactaaaacagagctagatatctataaagaacttcttgcaaatatgttggaagaattagaaggtatgcctaagaagagacctgatttgctagtctacattgatgtttcatttgataaaatgttagaacgtattgacaaacgaggacgcagctttgagcaagttgattctaacccagagttatacgactactacaaacaagtccattctgaatatccagaatggtatgaaaattacgacgtttcacctaaaattcggatcgatggtaacaaacttgatttcgtcaaaaatccagaggatcttcaacacgtccttgacactattgattccgaattgcaaaaacttgatttactataattaggtgatatctatgattataagacctgtcctaccctcagatgctaaagaattacttgctatctatgctccctacgttgctgacactacaataacgtttgaatacgatattcctagtatatcggaattcactaatcgtatcaaaaatatcagcaaatctttcccatatttagttgctgaagaaaatgggaaaatattaggttatgcatatgcttcaacttactacgctagagctgcctatgactggacttgcgagctttctatttaccttgataaagatgcacgtagcaaaaaaattggtagccaactatatgatacattggagaaagaattagttaaccaagggtatgttaatctactcgcttgtatcagtttaccaaatgatataagcattgcattccacaaaaaaagaggatttaatcaagtcgcacatttcccaaaaatcggatttaaatttgaacaatggcatgacattgtgtggttacaaaagcgattgaaatcttaaggtaatctttagatttattttaagttagcaaaagattaggatattataatatatttatcctaaaatttttcaacgactttcagtcgtacctatatctacaagtgcaattgttagatatagatccttttacttttcataaatctataagaaaatgtccaaaatattttggacgttttctttttatattaaaattccagtacccatcggtactggaatgttttatgattttgcaatatcaaatttcaatttgcctttggatacgccaatcttaattacttgcccctctttcacttgatttgccaatagtagttctgataaatgatcctctacttgcgtttgaatagttctacgcagtggacgagcacccatttctatatcatagccatcctctgccaagtgtttcaaggctgaaggctggaatttcagatccatacctttatctttaagcgctaaaattaaaggtttaaccataattttcacaacttcacgcatattatcttgactgagactatggaatacaactttctcatcaatacgattgataaactctggtcgataagcttttttaagctcctccataatacgtttttgcatagcagtataatcatggctgatatccttagctccaaaaccaactgttttatcgtcacgtaatgcagttgctcctaaattagaagtcataatgattatagtatttgaaaaatcaacttttcgtcctcgactatctgttaaaacgccatcatcaagcacttgtaataatacattaaaaatatctggatgagctttttcaacttcatcaaaaagtaaaactgaatatggtttattgcgtactttttcagtcaactctcctccttcatcataaccaacataacctggaggtgccccattcaggtgagaagctgcgaatttttccatatattccgacatatcaaaacgaattagggctgattcatcatcaaacaacacttctgccaaggcttttgctaactctgtcttaccaacaccagttggtcccaagaacataaaggaaccaataggacgcttaccagtacgaatgccagattgattgcgacggatagcacgactaatggcagtaactgcatcatcttgaccgataacacgtttatgcaattctttttctaaattgaggtattttttactatcagcttgtgtcaatttttcaacaggaataccagatagacgactgagagttgccataatatgatcttctgttacggcaataggcttacgctttttacccttataacttgcttttagagctttagaagcagatttcatatcatcatctaaaatagcttggtcaacttctgttaaaagcgaaggagcatttttcttaatcatcatttgcacagtggcagaagcttcatcaagtaagtctatagctgagtctggtaaattcttacttgtcaaataacgatgagccacttttacagcagtcataactgcttcatctgaaatagtaacattatgaaaggcttcatacgctggcttcaatccaagtagaatttcatatgcgtcttcaagatttggttcttctactaaaacttttgcaaagcgacgagataaagcagcatctttttcaatatgcttttgatattcctcttgagttgttgctccaacagtgcgtaaagtgcctcgggccaaagctggttttaaaatattagcagcatcaagtgtgctatcaataccagagccagaacccataatagtatgcagttcatcaatgaaaagaataatatgaccgtcttcttcaatatctgcaatgatttgattcatacgttcctcaaaatcaccacgaaaacgagttccagcaacaacgctcatcatatctaactctagaacacgcatatctctaagctcataaggaatatttccattagcaatacgttgtgctagaccgtacgccaaagctgttttaccgacacccgcatctccaactaagacaggattattctttgttttacgacttaagacttggaccatacgtgaaatttctttatcacgcccaataacaggttcaatttccccatcaaccgccatctgtgataaatcacgtgtgaaatcagctaaatcaccagcagtactcggtggtttcatcatatcagaaaaagaagcacccgactttgcttttttaggattacgtaattcataaattgctttgatatcatcttttgtaaaaccggcatgacgttctagagccttacgtaaatcaaccatacgaactgattcaccatcgtcttgacctctaaagccaactaactctaagatacgtgtggctaataaatctttattaaccaacatagcaagcaagacatgttcagtacccacatcttcagctcctactacgatactaatattttctgctaactttaagatctttttcaaagctggtgattgctctaaaaattgataattggtaatctcttctttcggtgctctacctaaagctaaaattgttgctgcttcgtactcttcaattgcaacttcagactcatattcagcaaatgtcaaaccagctactgaatcatgaactaaaaccattgctaaaagaagatgccagctttctaaatagtgactttcatagcgtgctgcttgaaattgcgccaatctgaatacttcttgtaattttatggaataatgactcataaatggaatccttttctatctaatcgttgtaataatttacggagcatacgagctctaataacagaggcttgctctcctaagacgtcatcacctgatgtcgccagaatcaaatttccttcacgttctgtaattatctcttcatcgaataataattgaatcaaatcatcaaaaacttgttcactgatacgctcgccaatcgttgataacatatttccaaataattggtgttgatcagaaaaatgaaccttagcaatgcggatgtaacctccaccacctcgtttactctcaaccacataaccacggctttcagtaaaccgtgtcttaatgacataattaatctgactaggaacaacttgaaaagtatcagctaaattggaacgctttatttcagcaattcctgattgttctaataatgattttatatattcttcaatattatcggaagtattttttatggccacaaattcactccttcctctttgactataactgactattattatatcaaatttttaaaagatacggaaatgaaatctatctaaggacagtaaaactagaatgaccgcggattttagttgtcattactagaaagataagataaaatggaataataccatagaaaggttttatttaatgaattacattattacatttttgatttcaatgattcccttagtggaactacgaggagctgtgccatttgcaatcgctaatggaatacctttgtgggaagcgctagctatcggtgttgttggaaacatgctacctgtacctatcatcttcttctttgctcgcaaagttctagaatggggagcagataaaccttatactggtaagtttttcacatggtgccttaaaaaaggacatagcggtggtcaaaaacttgaaaaagtagctggagaaaaaggattgtttattgccttgctattgtttgtaggcattcccttacccggaacaggagcctggactggcacgcttgcagctagcctcctagattgggaatttaaacatagtgttattgctgttatgctaggtgttatactagctggatgcatcatgggaacattatccattatcggcttcaacctattctagaaaagttaaggtgagatgactgtctctcctttttaatatttgccaatccaccaattcgatagcaaaataagacacttgacttaagccaagtgtcttattttaaaatatatttactgacaacattttgctgtcaaattataatataaagcgagtgttaattatttttcaagtgctgctgccattgtagctgcaacttctgcttcaaagtcgttagaagctttctcaataccttctccaacttcaaaacgtacgaaagcaactgctttagcatttactgactcaagataagcttcaactgttttgctatcatccatgatgtaaacttgagcaaggagtgtgtactcttggtcaactttagtgttgtcaagcatgaaacgatccattttacctggaacgattttatcccagattttttctggtttaccttctgcagctaattctgctttgatgtcttcttctgcttgggcaataacttcatcagtcaattgagcttttgatccatatttaaggaatggaagagctggtttgttaaccatagcacgactctcgttgtcttgctcaattttgtggttcaactgtgctaattcatcatgaacaaattgtgcatcaagttcagtatatgaaagaacagttggcttcatagctgcaacgtgcattgatacttgtttagcaagtgcatcgtcgccaccttcaacaacagtaattactccgatacgtccaccattatgttggtatgcaccaaaatgttgctcatcagtcttttcaactaaagcgaagcgacggaatgaaattttttcaccaattgtagcagttgcagttacaaatgcttgttctaaagtttcacctgaaggcattgttaaagcaagtgcttcttcattgtttgaaggacgtccttctgcaataactttagcagtttcattaactaatgttacaaattggtcgtttttagcaacaaagtcagtctcagcgttaacttcaataactgctgcaacgttaccatcaacataaacacctgttaaaccttcagcagcaacacggtctgcttttttagctgctttagccatacctttttcgcgaagtaattcaatcgctttatcaaggtcaccatcagtttctactaatgcttttttagcgtccataacgcctgcacctgatttttcacgcaattcttttacaagtttagctgtgatttctgccattttcgttctcctcttaatttcaaataatgattaaaaaaacgagacagagcggtttgcatctgccccgttttaggatttacaataaattaaatattagtcgttgtttgatccttcaactacttcaacgatttcttcaattgaatctgcttgtgcttcttgagcgaagtcaacgtcagcatcttcaccttgacgaccttcaataactgcatcagctaatttagaagtaattaatttaacggcgcgaatagcgtcatcgtttgctgggatgataacatcgatatcatctggatcagcgttagtgtcaaccatagctacaactggaataccaagttttttagcttctttaacagcgatttgctctttatgtgggtcaacaacatacattacatctgggatgcgtggcatatcttcgataccacccaagaatttttcaagacgtgcacgttgtttgtttaacaatgcaacttctttcttaggaagaagttcaaaagttccttcttcttccatacgtttgatttctttcaaacgagcaatacgtttttggatagttccccagttagtaagagttccacctaaccaacggtggttaatgaagtattgaccagcacgtttagcttcttcagcaacagcttcagctgcttgtttcttagtaccaacaaacaagataactgcatcgtttgctgcagcatcacgaacaaattcgtaagcttggtcagctaattttacagtttgttgaaggtcgataacgtggataccattacgttctgtgaagatgtacttagccatcttagggttccagcgacgagtttggtgaccaaagtgaacaccagcctcaagaagttgtttcattgaaattactgccatgagtaagttctcctttaaaaatgttttttcctctctcagacttcgacttgcagcctaacctttcggcaacaagaccacaattgatctaagatgagtatttgtcactttaagcaactataatagtttatcaaaaaaagttagatttgacaagctataaaatcttctactctattagaaaaatcatacttttcttagaaaaatgtaaacgtttttattggagatttaaaagtatttcgtttataattaggctattaaaaaataaaggaggacattattatgtcattagtcggaaaagaaattattgaattttcagctcaagcttatcacgatggaaaattcatcactgttacaaatgaagacgttaaaggaaaatgggcagttttttgtttctacccagcagacttttcatttgtttgcccaactgaacttggtgaccttcaagagcaatacgaaacacttaaatctcttgatgtagaagtttattctgtctctactgatactcattttgttcataaagcatggcatgatgactcagatgtcgttggtactatcacatatcctatgattggtgacccttcacaccttatttcacaaggttttgatgtccttggacaagatggtctagcacaacgtggtacatttatcattgatccagacggtgtcatccaaatgatggaaattaatgctgatggcatcggacgtgatgcaagtactctcattgataaagtccgtgctgctcaatacatccgccaacatacaggtgaagtttgtccagctaaatggaaagaaggagctgaaactttaactcctagtttagaccttgtaggtaaaatttaataaccaggaggtaatccatggtcttagataaagaaatcaaggctcaattagcgcaatatttagatttgctagaatctgatattgtattacaagctgatttaggagataacgataattctcaaaaagtaaaggattttctagatgaaattgtcgctatgtctgatcgcatcagccttgaatcaacacatttaaaacgtcaacctagttttggaattgcaaaaaaagggcatgaaagtcgcgttattttttcaggcttgccaatggggcatgaattcacatctttcattttagctttgttgcaagtctctggtcgcgcaccaaaagttgatgaagatattatcaaacgaattaaggggattgagaaaactatcaatctagaaacttatgtttcattaacttgccataattgtccagatgtcgttcaagcctttaatataatggctgttttgaatccgaatatcactcatactatgattgaaggaggcatgtatcaagacgaagtcaaatcaaaaggtatcatgtctgttcctactgtttataaggaccaagaagaatttacttctggccgtgctacaattgaacagcttttagaacaactagatggacctcttgatgctgaagcatttgctgacaaaggtgtctatgatgttctagttattggtggtggtcctgcaggtaacagtgctgcaatttatgccgcccgtaaagggttaaaaacaggtattttagcagaaacttttggtggacaagttatcgaaacagttggtattgagaacatgattggtacactgtacacagaaggccctaaattaatggctcaaattgaagagcataccaaatcttacgatattgatattatcaagagtcaattagcaactggcattgagaaaaaagaattagttgaggtaacactggctaacggagctattttacaagctaaaactgctatcctagctctgggtgctaagtggcgaaatatcaacgttcctggcgaggaagaattccgcaataaaggtgttacttactgtccacattgtgatggccctcttttcgaaggaaaagatgttgctgttataggtggtggtaattcaggtatggaagctgctttagatctagccggtgtcactaaacatgttacagtcctagaattcttacctgagctcaaagcagaccaagtactgcaagaacgagcagctaaaactgacaatttaactattcttaagaatgttgctactaaagatatcgttggtgaagatcatgtcactggtttaaactataccgatcgtgatacaaacgaagaaaaacacattgatttagaaggtgtttttgtacaaattggtcttgtaccaagtacatcttggctcaaggatagcggcattgaactcaatgaacgtcaagaaattgtcgttgataaatttggctcaacaaatatccctggtatttttgctgcaggtgactgtacagatgctgcctacaagcaaatcattatttccatggggtctggtgccacagctgccattggcgcatttgattatttaatcagacaataatctaaaagagattgatacaatgggtatcaatctctttttttgggtaatatgaggaagtttaagggctaaaattggctattttacgaaagaggcttgacgaatcttttttttttcgatagaatattatctgttatggcggtatagccaagtggtaaggcacggctctgcaaaagcttgatcgtcggttcaaatccgtctaccgcctttcagtacctgaattaacaggaattaaccgaatgaaaagcctgattttataggcttttttgattttccatcaggttaaatcaggctaactttaaaaataatttggggcgaatttggggcggacggtttttcataggtcaatttttgaaaagtattactatctattttcataattttttatacagaaaaaagcggccatcttgaccgctctttcttatacttgcaattcctcacggattgctttttgcaacagctggctaaagttgaccttgttttcttttccaacttccacaagccagcttggcagtgtgacagtcttgttgacaatcttagagcgttcacgctcacggacaagctcagtatcaactgaaatagcctgaatcacatcttcgtcacttgctaaattgcttgcaagagccttgaatgatgatgctttaggaaactctttgccctcgtcttcaaacataattgtatagatttcaaggacttcacgagcgttaaaaatggcctcgttcaagctatcagcttcactaaatgctccatgaaaatcagggaaagaaatgttatagccaccgttttctttatccacttcaaacaatgctaaataagtgtatttcataatattagattaagccaatgatcagagtatccccttttaggggtacggggaggagcgtcctcactccccatacaagactttgagaatgttgttcagtgtgcctggtctgtaatctttttcctttggcttaggtatcgtcactgtccgtccgtctggatgtttccaaacttcgtgtgaccctttgccaaagttagttttactaaaaccttgcttcttagcaattttcttaagctctcgctctgtcattggcttatctcctttccttatctttaattgtattatacacttgttttaaacacttgtcaatagaaaacacttgtttttaacaaatatttttaaaatttttaacaaaaaaagtccattataaccgatattttgagggaagtccgttataacggaaaaacagcccccggcaattgctgagggcttattttgtcttatcgtatctaattctaaactggctttttagtcagttcataagtgataccgttgatggtaacttcaataccttcaatagtaatgtcaatcttgtctttgctaccgtcaccaatgtcggtagctttatcaaacttgtccagtgaaccattttctgcctcaatagccttgaggcggcttgaagctccgacaatatagctatcaaagccgcttgcagcataatcatagacagcaccgccaactttaaacattcccttgatagcctcactgaaggttttagcaccagacaccttgtaagagccaccagcccttagaagataaaaccagtctgtcagaaagtcatccacgcttgcatagtgcatatagtgaccgccctcatttgaaggacgtgcggaaccttgtgtgacagtgacaccgcttggacggttgccttgaccagtccaggtcataccgccccagttattatctgccttcccaactgctgaagttccccaaagaccttcatagtgtaggatagtcagtgcataacttggaagaatatcatgctttttacagttgcccagaatcttgtccagcaccgcttttttcaagatagtcccattgaaagagaggtcgccctcttctttggtggctgtggcttgtccagttagctctgtttggcttgttttggtttccgtgggcttgtttacctcttgagccttaaacggctcagagggctgttttttgagcaattccgtcactcgtttctgaactgcatcatattgactaccaagcgactttttacgagcttcaccgttgccatgtttgccagcgattacctcttgaacaagttggtcaacagtcttttgattagtcgtagttttgccattgatgactgacataacagcctcatattgattgccaagcactgccttgcgtgcttcgccattaccgtagttaccagcaagggtttccttgaccaaggtatcaaggctttttccttgggtagaagctccgcttttcaaacggtaaacgtagcaatacatccagccactagcagccgctgtctgattgtagttgttcactgtgatgccattatttgcccagttacagtgaatgatattttcagggtcaataaacatgactacatgaccaccagctccgcttgagtgccctcgcatgccccaaattgctatatcaccacggacagcattccaatccacgttttcagcaataagctcataaccgtttttaatcagccaatcgtgcatgtactcagtgttgaccgcccaacctgctgagcttgcaccagctgacctgagagcataatagacagagctggaacagtcatagctgttagggccgtcacggtagtccatggaatagctgaccttgccttgacgtgcagacatccaggcaatggctatttcagtgttgatttccataggttactccttccaggcatcgtgcatttgtttgacagctgattcaacaaacaaagtgagatcatcgtctgacatgtggatattgtatttttgcaactcagctaaaatctgagccttagcagaagttagcttgtcagctcctttgaagccagtttcagtggccacttgctccacagcattaacagcgttcttggccaagatttctgtaatcaagacggccttttcaccgccttttttaatcaaataaaccttgacagcttgcactgcaattcctgccaaaatggtcaaaattcccatagctgagctgatgataatatctgtaatttgtgtcatgtttagtcctcctcaattggtaactgtttgaatttctcaaacaaggcttcaatttccccatttccgccaagcagttgataactctcaaagagaatgctcaactccctgaaatgttcaatagttgtgtagccttgagaaatttcctttgtcaaatcgtgaaaaagacggtaacgctggattttaagcgtaccgtcttttgtgatttctgaaattttctttgtttccgtggttgtatgatcaatcgtcttaaccttgtcaatcaagccagacaaatcttccttgatatcctcatactgatgttttatcagctggtctttccgattggctgaagtggtgataatagtgctgaacagaccgcccagcaccgtcaccatcgccacaaccacagtgctatctattaaccatggtggcattcactatctcctatcctgtttattttagatgagcttacttatcctccaagtgaggctcagtccagtcaggatttccgttctcatcaaaggtcatgatgtagtattcaagattaaagaaatcagctatgttgattgtgggtgttgtcccgccccattggttaaatgcccagacagtttctacgtccttgaattgacggcggccattgacgatgacaggacgtttctgcatgtcacggtacatgtagaagtcattgacagcattcttgcaacggatgaactcaccattttccttcatgtacttgagtgctgtcgccaagtcaaagggttctgtgattgtttcaaggtcaagtaaattattttctgttgtagtcacggttattctccttcaatgatttctggttgagtttgttcatcaagcaagccttctagttcggaaactcttgcttgaagttcagcattttgctgagtcagttgctgtttctcctgaacaacttcagtcagctggatagccagcaagttcttagtggttgactcattggccaactgggctgtcaattcattgaccgtcaagcgtagcgcttgattgagttgttgttcttggttcatgattgttcctttctagttagaaccctgaagggtagtaagtgtaagagtcagcatttgggccttttgagaagttctcattgaatgagttcaaaatatctctgagagaagaataggatccatttccttttaaaatccagacatcaccaacctcaattcggctattgcgttcagcagccctattgtgtggtgtgattttcaagcctgaatcaagtgtccgaacatcccaaccatctgaattgtcaaaggcagagcttgctaatcggatttcatcaccaactaagtcaagtgagtcaatgtttgagccgttccatgcacggactccaacaaatccaccatcattggttgattctgtaccgtagcggttagaaccaatgaccgtaacaccagcatttcctttaccagatactgtaccagttgcgaacttaacaaactgagtaggatagccactcaaaacccgtttcagtgcagcttggtcagtgtagtaaagtatctgaccactgttcatctggatttccatggcattattcaaagctttaataacaccgcccgaaatctgactggcagatattgtcacggattgaacctgagtgatgaaggctgacttggcaaatagttgcttcaagtaggcatcgttggccatcaacttgttaaagaaagcttggtcgactttaagtttttctgccgttacagcttcagctgctaaaagcactcctgtgattgctccagccttaacatgtcccgtttcgacagcgcctgttaccaacttacgactagttacagaaccatcaaccaacatgttcccgctaacttttatcagtgagctaaacagagctatagcatcaggagtgaccttaaagtaagagccaatagctcttgccacatcattactcgtcttgcctgctctcaggacaatcccttcagaagtcatagtaatatcagtttgcttaagagttttatgatcaagacttgttacactagctttaatctcattagctgtctgttcaagcttagtatctgagtaggctttcaggtcatctggagatggactccagtccgcaggaattgtccccttagtcacacgaagtgttgtcactctaaacttaagttggctatccgtaaatctaattttaagggagtttgccctgaaattggcattgtttgccacaaaagatgcggtataggtaccacgatttgatatcgttctctgtacctcaccaacccgttcgattttgcctgcatgtccgtatagctccagttcataagaaccaaaagccgtccgactatccgcaaaatagttaaatgcaatagttacagtatctcccatttcaatcccttttacggctaaggtagtaccgaagctataaaggtcatagacggtagtccctgaaacgtttagatagacatctctttcagtccccaaagcatagttctgtgtccctgatgacagactttcaaagcgtcttatcaaacctcttgcattttcctcataggttgacttatccacataagagccattaacctctgttcgtaaggctgatagctgcttagcggtttcagacttgcttgcttcaaagtaacgactagctcgatttggttcactatctttataggtctcaagactaactaaacgattgctaaaggattccgacgtctgcctaatgctagactcagcacttgtcagttgacctgccaaggtttccgtacttgttctaaggttggctaagttttcatcaacggtctgcttgtattcggcgaagctagcttttaaggtttcatcgcgattattccagtctgtagcaacggtaccacgttccagcttaactttcgagagcgtcaaggggttagcatttgtcccccgcatcacaagccaggcttggtttctagggtcaggcataacaccacctaaatcaaagctctgagagataaagcctttccctggagataagtcaaagttaggcatgacaataattgtaatcttactagtgtccccggtgtgcatctttttataaagtctaacttctaaacgactagttgattctgcttcatagctaaaactcaaggtcgcttgactagttcgttcgagtagttggggattaatatcataggtcttaccatagaagttagccattagttctttaggttctccgccgtcaatgacataattatagccaccaacagagaatgactccagtttcgtgctaagtcctgtcagtttatcctcaacccgctttgtcgcaagttgttggacgctatcagcttcctttagccttgtctctgcgtctctaaggtcgtttagggctttttgcttaatgatatccatattgtgactaagatttgttagagagatttttacagcttctgtgcttgtgacttgtctatttaattcagctctaagctctatttcttttctggtcaagtctgcttgtgcctgactggctaaattcttagcttctgtcgcaaggggaagaagctgattatccatgcgattagatagttccgatttaaagctttctactttggcttttgcgatttcgatatcatcattaatttttgtttttgttttaccaaactctgcatcaaaggcagcgttagcatttttcacagccctttgaacagcaacgtcctgagctgtggcacttgctacaagtatagcatcagcaacattagacaagccacttgacaccccagaaccaccaactcctggcttatcatcaaaagttatggagatatactcttccgttaaagcgttaaactcgtaggcaatggccttcttgtagaggtcagcactgtgctttctactcttgaggttaaccgtgtcgcccagatttacaacttgaccgtcaagctcataggcttcaatctcaatggcatcagaaaccttatcaatgccctcatttgtaaacttagcctcagcccactttctaaggtcttcaacggtttcagcgttgttgttctcatactctttctcattgatgtagggataagagtttattagtggactgtcaacagacactctgagcgtcacttcatcttcagctccatcaggtttgaaggttgaccgtgcatgaatccttgtgacaacaccctgagagttcttggttcgttgataggatttgaggttcttgtgtgttgtgatgacaacaccacgatcagccccacggctacgtttgatagataaggcaaagttatcacggacaagctcaccttcccacgttccaacaatactgtgtttaccgtccataaggacagagtagagcgtttccgtttcagtcgtgttaaaggttcggctgtccataatatcgctggtaaaggagaaatcacctagcccagtcttagcattttgaaccatctgagacagtgccatagcacagccttgaccaaccacactcacaggagtgatagaccgcttcatgatgtcatcagagacatgataggcagtgatgtccatgctgtcgtcattctcaataggcttcttgatacggaacagctgagcgcccagcacaggcacaggcgacttaatcagcatatcctctttgataagctgatagatacctgaatccgtgataggatagcgaacagtcaggtagaaatcaccgttggtttcttctttgacaatggcagagctggcttcatgtagtggaatgccattccatttgaccgttcttacatttgcatcaagtaaaaagagcaactatgcccacccccaaactgtttcaaatttcaaagatgttatgccagcacctaaaacaacaccgacattctgccccttagcagtatcaactgtgataaaatcaccagcccacttaatgagttttccactagccgtcttaaagctaggattgtcaggatcattggtcatcacgagcgattctgagagcttttcaagcttaatcacttggttacctatcgtaaacgatgtctcagaagcgctctgaccaaccactgtaatcttcggaaaagcaagagctgacccttgaaccctcaaaaccccattaccagtcaatgtctggatgtcagtggtcttgaaaaacttggtagggtggcagatgaaggtaacatcgaccacccaggcaccaaattcgtcttttccaatctcaaagctatcaaccttataacaccaaagcctaatagttggttcctgttcattttccaaccaaaacttttcacggttcaaaagagcagaaaagcgataaatttcttcatcgcttggctcaattaaagtgatatgataaggcttctcaattagtccacggtgtctattcgattgcacaactgcaccactaataccatcatgctctaatagagctgttttggagctggagacaatgacatttggtctagtttcaaccaatacatcacacttaaaagatgatgttttcacaccgtcaatggtaagttcattgatttttgtcatgccattcctcctctcaaattagttttacgttgcaattcttcagcaatacgatttccaaccacgttggctagtctgttaaggtcagcttcttccctgatagtgacgccagagaagttaacgttaatattgttcgatgtattcatcgtgttagcaatactttgaccaattgcccccagggttgacttattcaatggcaagatggcttcagcgccagcctcaccgccaaccattgcacggtttccattcatgccaaatagggttggtttggtcatgataccgcccttggcataccagtcaatgccgatacttggtaagccaccttttagccaatccagagggttagcagaaccactcacacggaagtgaggtagtggaatatgaggccatttaatctggaagttaaacagattcttgatggcattgaccccgttggacactgcatttttcgccccatctattgcattggaaatagtggattttatggaattccaaatattgcttgctgttgaaagtatcccattaaaaattcctgaaatcgtgctactcaaattattaaacaaatttgacccagttgagaccagtccagaccacaaattggaaagagtggaagtgaaacttgaccacagagactgagcacctgtaatcaaacttgagaaaatattggacaaggaactagtaaagctagaccacaaagactgtccagttgagactactgaagaccaaaggccagaaagccaggcagtgaaatttgaccacgctgtggtggcagtcgtgactatgttagtccacaattcagaaagccaggcagcacaagaatcccacgttgactgaagccattcagttatggctccccagttcatgattgcttggatgataagtgttatgacggcaatagcccctactattgccgccactacaattccgacaggcgcacctattgcccctatggcgatgaccagcggtgcaattgcaccaagcaacatcatcacagcagttgtaactaggccaagaatcacgatagtctgttgatcagtttcgtttaggctagtaaaccaattgacagaagattcaagcatacccatcaaaggttctaaagctgggatgacagtctcaagcaatttaccgccaagttctgccattccctcttttgcttggttagaatactgagtcaacttatctattgggtcaagcgtctcatcaaatgtggtggagacagtaccagaggaacttttagctgcttcagctaagtcatcaaagctaaaagcaccacgctgaatagcatcgaccattctaggagcagccttactaccaaagatttctgaggcaatacttaaagcctctgtctcactagtagaattttgaatagcactaacagtctcattcaatccatctgtcagagtcttaccgtctttagcatagatgacagcagctttcgatagagaggatagagcagcagatgaatccacaccgcttttctcaaacttaccgatcagtgcagcaccttcttcaaaagaaagtcccaaacctttaatctgaggagcaccgtcaatggctttttgaacaatcgtgtcaactgactgtcctgtatcttgagcggctttggtcacattgtctaagaccattcccaagtcttcagctgtcaaaccgtaagcttcaatagcttgttttgcagaaatggcagagcttgaaatgtctgtttcgttaatctcagcatacttgataagtaattcagatgctgatttcagcttttccccagtcaaaccgaactgagtattcaattccccaacggcatcaccagcattctgaaagctggtaggcataccagtagcaatgtctttagcaatttcctgaagctctgctaaggcatcaccagtcagaccagttttggttgtgacggtgtccagagcctcatctatctcagaccaagcatctactgtcattttcccagcgtcaaccattttctggccaatctgaccagccttatctgcaacatccatcatgacatcagctcttaaatagctggttgcctctttgatgtctccagttgcagaacggcttgactcaccaagaatgtccattgcacggtcaatctttagaacttcaacttcagcttgaccgatttcattttgaagttgacgccattcttctgtacctattttctcatcgccaagggcagcttgttttttctttaattcttggactttatccccagccaattccgactgtttgccaagtagtttcattttttgctctgctagttcgacattgtcagggtctagctcaagcttttgattgacaatatcaagctctttagcaacattatcaagttctttgttaagattcagaatagactttgggtctcctacatcttcaatgtgtttctttgttgactccattgccttatcaacaatcttcatctgtgattcaaccttagcaatttcaagttgaagcttattccactgtgctgacccaacttcagattctcccagtgccttctgttgctttttgagttcagcaatttttatagcaccaacacgagcctgttcttgcaagttaaccaacttacgattcaacaagtcaacattgtctggatccatcttcaattgtctgttgatgttattgaagtcttttttcaaactagataaggcagtgttgataccttttacagacctatcaaattcaacagtattagcaccaaatttgacgtataagccttcaaacgtttcagtcatagatttcctcctttctttttaatctgacatcacgctaagtaaatcagcgttggataaggttttcttttcttcctgattgatgctcatttggtgaagcgttcccatcaaatagttaaagtgttgggattctgcccaaaaaacatccatccgattttcaaagataaccttataaaccttttcggaagttacaacttctgaagaggcttttttttatcttgcggcacctttgctctgcttcggttaaattcatagaagaggtctgagaagaaaccaatatcaatcaaatcaccaaaccaaggagctaatgaagctgtttcagcggtaagctcattttgtactaaacgtccattttcaacctcaccataaaggcaaggaatgacttcagtcaagaagttcatgaaatcaggttccataagtagaggcatcatcttgattttctcttcatcagttaaatcagataggttacagtttacaccagttgcaagagcaagttgtgtatatgctgtaagtgctttttggttgtcatcaaagaagttacgaccagttcgctgttcatacatcttgatagctggtaaagagtaaagaaagcgcactgtttcagtgtgctctctttcttcaccgtaactatcaaacgctgtgaatgatagttcttttttaatcattaagagcctccgctaacagttgtggtaggtgtagtggttgttccaagcgcttcattgatgaaatcaatcagcttgcctggtgacttgtcagcaaacaacttgtcaaacttcccacggacggttcctttgctgtcatcacgccatacaatttctgatacaggtttcttttcagaatccacaatgaagttatttggagaggcagtacaagggatttcaatttcttttggtgtcgctgatgtttcatcagttgatgtgctgcctttaggtgcagatgccttaacgttcgtccaaatgtggaactcttcaatctcagctccaaactcatctgtaacagtttcagcataaccccaaatgaagttagtattgacaccagtatcaatcaaagctggtggtgtagagttcgtaagctttttacctaagtgatcaatcataaactgtttaggaatctgataggttgtaatagacccttctgtggattttttaccttgcaaacgaacatgttccacattgtctgcatagtaggcatttgattcctgagaagtttcaaaggatgtgcttcgtagccctgtaaagggataaggtttctgcaagtctaaggcaccagcatcagttttagcaattttggcataaaaaccattcgcattaccgtgagtgacttcccttgtatcgtattgataagtcatgtaagactcctttcttatttaggtgtgattttaatggatttcatatcattaaggaatttctccttattcttgaggtaggctggtctgatatgctctctaggggcaacaaagccaccgtttttagtggcatgaccattctctaataggtgggatagagatttttctttgccattattatgaacaacagcggcgtcatctatgatgtcgtgtgtccaacctttttcgtaaacaccgtttcgtctagggcttccagttctaatgtcattttctgtactttgggcagccttcttaatgttctctaaaacttgattcttgatatccacctttagcggtgtcatcttcacgctaccaccgcccatttgtaaacacctcaagtctgtaagttgtcagtagatagtcagtgtcaggttgttttagattcaattgatttggctcacacataaaattagacagcatcaaattttcaatgttgtctagtttcttcttgtggtagtgactaacttgcaaagtcacttttctcatgtgcactctatcatcagcagtaatgctactgcctggtgttaaccgataatacaagatgacattgtcaggagaagatttctcctcacgttccatgtagaagaccttagccttcaaagggtttgtttcaaggatagattgaatatcttgtctagtgaaaaatttcttggccattatttcagttctccaagttcgatgatagtgtaatgaccatcatctgattctgtcccaatgttaaccttgtactctttgccattatatttgacatagtcaagagtgtcagtcacatagttggaacgaacactaaacctagcagtcagaacttgaccgtctgccatagctttatcaagccttcgctgatagattttctctttctcagctttgactttcttttctacggtctttttctcccagacacctttttcaacctcaacacgctcatcatagcaaagaatgatagctactcttgaagatttcatgtcttcacttcatagattgccttgagttgatacaaaagatttgtcatctctccgtcaatccattccatagtagcagcactgcctgtcatcaaagatttgtcaaaacgttgaacgcatctcagatgtaaccagtcaagcactgtctccctatcttcttccttaatgtctgtccatccctctaactccgtttctttatcgatacggataacaggaatagcatttctttgtaaatatgaaatcccactgttgatatatcgtaaaagttggacgtcaaagatatcctcttcaacgtcaacttctaccatttctttgattgttttaaggattgtcattcagactcccctttctatatttaacctgctgggtttgtaaacttaaccgctgatttgtactgagccaaacgaccacccataacactagcaagctcaatatgacggcggttgactgttacatcataatcatcaaagcggtcagcggcagcctcatcaccaatcatcttataagcttggtcagcaaatgcaatgattgggttagttgcaccgtccatccagtcatagatgtaaacttgaaaaccagcaataacatttccgttggttgcaattggagcaaatggttgaggatcgatgtagcgaccttctgcatctttgaccaatttcaatttacgagcaatggcttttgaagtgacaagaattggagtagtatttggaaccatcttatcaataccagcaaccagcgtttcaagaacagcattgtcaaatacaccagcaacattgatttcttgtgtttcaaagagattcgcttcagtttcttcagcaattgatttgatttcagtgattttgtcttcagcactgttagattttccatcaccaatgacaacagcacgttcaatagttcggatgaagccttgagcaagttctttcatcacatagttgaagtaagcgcctgttgtatctttcttcaagtcagaatattcaaaggcatatttgatataaactgtcgcagagttgatagtgaaatccaagaatgtgaagtcttcatctttcttagtcttaccagctttgtgtcctttagcttgagatacttgagtttgaagagcaacacgcaccgcataacgtggatcttttgaaacgtggttcaagatcccattatagttagtaaaggcatcttgaatagcgataagaacaggttctggaagaatcttagtgaggttagtcactcctttttcaacaaggttagcttcccacgctttacgggcactgtttgcgctaccttcgttgtccatcagaatacggacaaagtcaagagcagcggctttggttttcaaataatccataggtgtattacctttctgtttttctttaatgattttagcagctttgctgagttcttcttcagtttcttcaatgtcagaatccagcccagcaattgtttccttaatagctgttgcttgagaaaccaaactttctgcatcagtttttaactgttccaagtcatcgtcttcaatggttgaagatttcatctttgcttcaatagtggcttttttaagctttacctcagccagttcatcagttgctttttgacgagcttccaaaagctcaatgagtgattttttcatcatgtctcctttaaatttttgcaagtttactcatgatttcttgcctcatgttcgcctgagcgattcgcttatcaaccgccgacatatcaaattccttaatattgtcaacagttgcttgagggttagctggcacggtcacaacagaaatttcaaagatttcaacttccttgaaaatccatccgccataaggttgcttagcgtcaataggctcataatctttaataaagaacccaatactcaggctatccaatgcccccattttcatgaggtcataagttttcttagcctctggatcactaagattaaacgttgaacgtgttcgcaagcctttttcatccacagacaattcatgcttaccaataacacagttacggtcatgattaagacacatagggacaacagccttagatttcagagtgttatcaaaacaccccttggccatcacatcgccttctctgtctgtattgtcataggttgaagcgtaagcctcaaaatgaaagtcagctgattcatcctcaaccgacttcacaacaaaggtttttagtttttccattgcttacctcctttcgtgaaagatatgccaaccacccaccctttagattctactcagattcttctgcaccgatacgaacagcattcaggttggtttcaaatacttcaccgccctcatagccaggtaaaccaagataggtttcacggaactcatttgagttcatcaatccagcatatttggacttgaagccaccttcaaccaaatccttaaatgaaatcatgtcagccatatcaaagaagaccagtaacttattgccctgagtccgtgctgtcttcgtgaagtattttctgttaatctcctcagaatagacacgctgatataacttcatgacgctagaatagtaggctctatattgttcctcagtatagtcacaggtaaataatttctcattgataccatgagcattataaagctgtgatttcaagaactctaattcttccttagaagcagtagaatagtctttgctaagttcctggaattcttcgccttgctcaagataagcaatgccaccgttcttggccaagtcaagcatactatcaacacggtccctggcttgttgcttcaaatgttcatcagctgccttagttggtagctttaagaaacctctcaagctagaattgccatcgctaagcttttctgtcaaagcattcaagttaatgtcaataagctcagtaatctgattgagttgagccgtgacattcaacttaggattttcaaatacccacacatcagtaagaggaagctcaacagcaacatcatcaagcataagctccacgctctctgctgtccaagtcactgtcttcttagcaagccatatttcaaccagtcggccattcttccaacgtggtacaacaaccgccacaccgtcacgcagcatagccctagttacatttgaccaaaagacaacaggcacttctagtggatttggtgaaactgttagcacctcagccaaatcactatgctcataccaaaccatcgaatcgacaccgcctgggttacgagtaatcttgacatgcttaaaccttaactgagctgtgtcagttgaaatcttattgtagatgttatccaaatagatggagttcctacgccagtaggagatacttctttgaagataggttcttgtagatttccgattgtttggacggaaaatcctagcaaaaacctccttcaaatttttcaaatagttgttcattcttcacctcaatcaaagtagtagctcaagtcttccttgaaattttcataacagataaaggcatctagctgactagcaaagacatcaatcttttcttttgccttttccttgtttggaaaaatattgttattggcatcaattttgacacggacgttggcatgattccatgtcgccacaggatcatcaaagatgattttgcccatcttagccttctccttgtaaaccttgagcggatttgataacgatttgaccgtctggggaatatcgtgacaaatatccccgtagtagtcgttaaacaagcgaataagttcccttgcattgtagcggtcataaccgactgccacaggcaaaattctgttgtcactcataaactgccgtaactcttcaaatatataggcttggtcattgtagtccaattcatgcacatgcagcatgccacttaattcccactcagtgtacttatcacgcagttcctttggcaatgtctcaatggtatgccgtggcatgaatttcttgtttagatagtgccgttcttccccacgcacaaccataaaagagatagagcagatgtcattgacatctgacaagtcaatcccaatcacacaacgggcgttccgttcatcatctccgacaaacaaactctcatcaaacttatctgaccaacctttacactcttcattgctgaagtaagcaagatagttgttgacaggaagattgaaagtcttagccatcagctcagcttgttgtgctggatcattcttgctcatctcaatatcacgagcgatggtttctttctctgtcgtgataccaagtaatggcatagctttctgccacatatcagggtcatgaatctctgacacatcgtccaactgataaatccaaggcatgacagaatcattgataatcttgtcatcaaggatatctacccagatgttgtaatacttatcaaagagcttgtcacgcttcgttccatttgtggaaatgtaccaggttatccaattcttacgcttacggctggaaccatcattcacaaccttgatgaagtcatcatcataagtgtgcacctcatcaaagatattgtagtgagcattagtaccgtcaaggctttcatagtcagaagtcttgatagacataagactgttagttgtttcatacaagataccttgcttggttgaccgtaggatgtcagcctcacgcatatagtgcagcaagctttcttcattcgacaacatcgcccttgaggcattgaacaaatagccagcctgttcacgactgtaagcaagaagctgaatatcagcaccccactcaccgtcaatgatttgaccaacctcagcaatagcagaaccaagagtagtcttacctgtgccacgaggcacaataataggcacctcatgaatgagacgcctttcttcataatctgtgtattcttccaaggtatcaggattggtcttagtaacctcaaccgtgtgataaaagccccacgttgtttctaaccaaaccttttgtggtaatgctaagcgtaacttaccagcaaggcctttagtattgctgcactcttcctcaatgaactcaatccgtttgtcagcttcctcctgtttgaagaggtattgctctttgtatcgctcaacacgtctaattgatttcattgtgagcttacaaatacgaatcttaccagtatagatgagctgagcatacttatcaaaatatctcatctcaaccataacgtgctaacttctcctgaatcatttctttgagcctgtcaccctgtggactttgcttttcaatcgttgacatgatctgcatgttaagcttttgatacttttccattccatcaagtaggtacttatcaggtagctcaccgtcattgatgaccttattgatttcaagctggaagttttcaatcactttttgattgtgattgtattgagttttgagatttttcaacccaactgaatcattatcactgatttcaagcattttttcttttggaatcagcttgaaagtcttacgagatagctcaacacgttcctgccttgtgtacttttgccgttgattggcaagcttttccaactctttgaactgacttttggtgatatttgacctagtttcttcaaatatgcccagcttttttcgataccttgtaagggtagcacgacttattcctagcttttctaaaacttcattgattttcaaaatcatgctcctttcttgtatcaattttcgtcaattttgggggagaggtacacaagaggattgacaccgttattattttggcgctgtcaaaattcaaaatggggggagtccacaaaaattcaaaaataaaaaaatcaaaaataaatttatattccgattatctaaatttaaatttattttactttgaaaagtttttgtgttgtgacattcaagacaaagtaactgacagttctcttcgttgagagtgatagattcatcttgataattagtttcgtcaatctctatgatgtggtcaacaatactcttaccgtgaatcaaacgtccgcacatgtcacaacgcatacgcttagcttttctgattttatttctcagagttctccaaggtttcgagttgtagaatttaatctgccaagctctgaaccagtcagagtgtttagggtttctatagcccactacattgaccccaatgcaaaactatctcttgcaacctctcttgaaatgtctctaaactttaaatctgcttcactcactattcttttgtcatagttgattaacggatttagaatattatttacaaaacttggctttattacgattttatttacagtctcgttaggcttaatatctaaagtcacctcatatccatttgcaatatgttctaagtcgttcttcgtgagatagatttctaaagtgctaccagcttcaagcctaattccatcaaatgcattttcatctttcatggcatcgtcacccccaacaaaaaaaagaacatgcctaagcttgctctctggatttttctcatgttacaaatatatcagattgtttttgtcaataatacccatttttttgacaagattatttttctatggctgaaattatgtaaaataaccatgctgaactatctatatcttatattttatccaattttgtttcacactagaaaactaattaggacaaggctttaagctcacttcaaaatatagactagaaacttcctcgttatggatagttgaaaaaatcaaaaaaatattagaggctaaaattactcatcttagtatcaagctcatcttgccttacacaaatgtagattagtgtaactgctgggcttgaatgattgaatagtgacatcaagtcagcaacgttcttgtacttcttgtagtaatgatagccaaaggtttttcgcattgtatgagttccaacattgtcaatgccgaggtcttcagcagctcttttaagaaaccagtaaaccgtcttataactgagcgccttgttctttccgacacgactctgaaatagatactcatgaagttccttgtctttgacaaattccctcaattcgtttttgagtggccttgtcatcttaatacttttatacttaccagtcttttgttccctaactttgatgtgccagccttggacatctttgacctttagcttgagaatatctccaacacggaaacctgtattgatgcccaaaagaaatagcatgtaatacttttcattccaagatgatagatagtccttcatggcttgtatatcgtctttgtctcgtagcggttcaacaatattcatcgctttgctcctttctcaaaaaaataaagcaccaaggatttctcggtgcttagcgacactatcaatctatcagattgtttctgtcaattctatatgtttttttgacaagttacatgaacaataattttgcaagtgtatcaaggatgacttcacgtcttctataaatctgcttgctatgtctgtaaagataacctgtctcgccattttccatgatgtgccaaacttgaatccaatcatatccagtatgttctccccacctcagatggaaaattttcttatcatcgggttcaagtacctctagtaattctgatatcgcattttggaactcttccagtttcagaatcattgggtcactggcataagcaacagctagattttcagaagtattagttgaagttccactgcgactagctcctgaatcatcgattcctggcattgtcaggtttttgactgcatagattctttccagttcatgacggcgctgcccaataagtttatcaatttttagatacttagcctcaagctcaaactcaaggaaatcacgtcttgtcttacttgctgttttctttgtcaaattgttctcctttggaatgctcttcttgattctttccacttgatgattctgccattattatcattgttccaatatggcggtaatctacagccttccttttccacatagataatcttttcaacaacggtttcaagtggttgtggttgctggccttcatcaatccaaccaagcaaccaggctgggttgatattgtaagccttagcgatattttcaacctgaccaatagatggtgtaccgcctttttcataatgtagcagcgtgttcatagaaatgccagtggcttcatgcacatctctgcgactgaggccaagtttgtttcttagttcttcaagccttaacttcatcttcccctccatcttctgtgtggtcttcgattttctgattttgcacgagcaatagcagagcgacacatgtcatcccagacatagtcagcattttccaactgcaaatcaaggcatctaaccttcagacggtcattctcaacttctagccgttcaatgtctttgtatgctctgttatataattcatcttcaagaaatctaatacgctcagccattgcctcttgaatgacgatgtaggtgggtttcttatattcgttcataagcacctcctaaaacggtagatcatcatctgaaatatccataggctgactatttccaaatgatggtggcaattggtcatccatgcttgcctggttcgttgaattatcacgcttttcaagaatctggaagctgtcagcaacaacctcagtcacatagatacgctgaccttgctgattttcgtagcttcttgtctggattcgtccagtaataccaatcagcattccttttttcgtccaattggccaagttttcagcttgttgtcgccacatcacacagttgatgaaatcagcttcacgatcaccagcagcattcttgaaatttcgattgactgctaggttaaaagtagcgtttgcgatgtttgacggcgtgtaacgtagctcaacatctcttgtcaagcggccaataagtacaacattattgatcatcaacctcaccaacctttctgaaaatgtacttgtcagagaactcttttctgtatctctttttggtaaccctcatagcctcatttttattagtcgttggcacgtttgggttagcactatgaagatagacaggcataacctttccaccaacaaaagcatcaaattctttaaattcaaggattcctattgattttttcatttctctttctccatttcttcaatcaaccagtcaaggttctttcttgcttttttgaggtcttcaaggccgtttttctttcggtaccgtagttggtactttagggcatttcctagataaaatcctttgagcatttcaggggtcataaagttcctgagaacatcaattgactctaaaccgtatttcccttgataatggctaggatagtttacattgtcatgcaagattctgaatccagttatcttacctagctcactttctatctttgtgtagccttgttcaatgagtttcttcatttcctcatcttcatcatttagaatattgagccgttttgtcataaaatcacattttgtcattagtttccacgtcctttcaaatagtcaggaatgtcatcaccaacagtaatttcattgtattgttcctcagtaaccaagaacttgccataagcgccagctgtaactgtgtgacggccttcaatgatttctttatcagtgattttgccaaacatttcagcgccagcattgtcagccacatagataatcaccctgtcagcttcctgatggcctttctggtagccaatatcataaaacagatagttgaatccaaaaacaaatacagtgatgatgatggcactagcaaaagccttgagattgttgaagaattcttcccaattcaggtttttcattacaaatcctcctctttaacccaaattccattgattaacttgccttttctgtccttgatttcttcataggcaatagccaagcaatcatcagccgttgtcagattgtggattgcaatggaatgaatattagagtgaagcaagctaagttctggacggataagcggtgtttttgtttcgttgtggaagatatgcttgtagagtttctgagccatctcccccaaacttgaagcaagtagcaacagctccatatcttgtggacttgcttcaatctgagcaccgttcttgatttgttgttcaatgccaatcaggacaacttgcatgtccccaagtgaatcacggatgatttcactcttaccctttgcaataccagagtaaagctccccagtttcctcaatcagcttctgaaactgcttgacaggatttgcctcgtgtaagttacggtcaataaaccactgttcaaccttctcttcaagtgtcattgttttagtcattttgataaacctttcttaatattgtttttagattttcgttgattctatcagcctctttttcatcgataagaaaattgtctgcactttcattgatttctgagatggcaaactgtatagcatcacgatagccctgcttatagtcaatattattgctcattttgtttttcctccgtttttttttaattaaagtaatcaagtagtagcaagttttagaaccataatcaattctgatttccttgctccgtattttcattgttgcaactacccttggtctatgtatgccagagttctcaatgatatggtcaataattgcttgggcagccaactccttagattcaaactggccaattggaacagctttgtaaccatatagcatgaatgtagcttcataggtcatagcaatctccttgcaattgcagcaatgacgtttactgttacgctattaccagcttgtttatataattgactgttgctattgacctgactcgccttgtcaaaagcccagtcagggaagccttgtagcctccaacactcacgaggtgtaagctttctgattctaaatccgttagagataccaaaagtacccgtagtagtattaccgttatgaccgctagctgttaaagtgccaacaatatctttctttcttctgttgtacaagtcataaacaaccacaccttgttcttctccagtcaagagagtattggcaatacctttaccaactcgtccacgtcttgtctcagaatttgggtgagataagtttactgaatcgccagcctctgcctctgaatagccttttttagtggcttcttttatctttaaaagattgttttcttgccaactgttgcatgtgacagttggagaaatttcatattctcctccctgattatagcctctgcctcgctgaattatttttggctctaaccctccaccttgcatagttctgatagtcggtgctaggccatctggatcgtagactctatttggcatttcaaatttcccaggtaatctgcctacaacatttacagcgattttaactccttctcccttatttgttgttagagttggagataaaccttccgaatcatacacttccccattcattccattaccagatggattaacatttcctatttttctggtgtggataggataattttctgtgatgcttgattcgaaaggaaaaattggtctggtaccttctcctctaagatgtccgataataaacactcgttccctattctgggggactccaaaattcttgctgttaaagatttgccattccacgttgtaccccaattcatccaaggttctgatgatggtctcgaatgtagcccccccttcgtggttgaggagtcctttaacgttctcaaggaatagatacttaggtctgagaatagatgcgaacctagcaatttcaaagaacaaagttcctcgtgtatcttcaaaacctcgtctatttccagcaattgagaaagcctggcacggaaatccgccacagataacgtccacacttccgattcctcgaataaactcatctgaaactcttgtgatgtcatgtagttcaatttctccttcagtatcatgtattactttgtagctagctctagcaaatttatttatttcacagaatcctatgcactcatgcccagcttgctccattccaaggcgaaaaccaccaatgccagcaaagaggtctaaaaatttcatcaatacctcctatcttccatatccttcggataagcaaagctatttccagtcacaccctcaagaatccgactagacaaagcaccgttgccataattgtcagcatacaaggccttaatctccttactactcaggttagtgttgatgattgtgttgctccgattgtccaaaatctcatagagaatctgatgtgtccactcattgttctggctgtcgcctttgcgactctccttgcccaaatcgtccagaaagaggtagtccaccctagttagcagctcaatcatgtcagcctgtctgtacccattgtcaaccttgaagctttcttttattttggtaaaaaggctcaccagtgagataaaaagaactgattttggtgattcgtaggctttgaattgttcgttcatgaacttggccaagccgtaagtcagatgacttttgccaacaccagaagggccagtaataatggcattgcctgttctatcctgtcggtagaactgttccatacgcttggcataattgatagcatgctggtcaatttcatccttgatttcatagttctcaagactcttagccctcagcttatctgataccaagctatctctttcaaagacagcatatgtatcagcaagcttgctgttgattttgctctgactgttcaacttattttcaaagatgttgatagcggccttggtacactctggacactgcttgagttcttcaagccgtcccttaatcggtactttagtcagccagagctggcaaccgtgaacctcgcaggtttcttccaagacttgcctagtttcaaaattcttaaaaggattcatctaaaagcccaaccttccgtcaattgtttccgtcttgattcgtggtgcttgattcaaatagccttcaaacttagaaccaaagagcgtttcaggtctgagatacttttcatacttagtgcctgaccaatccttgaccgtggtatcaatcacatgtttgaaatcatctaacctgaatccttctgaccatctagccttgataagagttttgtttttctgaatgttaggtctgtaatttctattagctttttcattcaagtaagaaataatttccttgtatggaatatcttcttcctcattgtctgaaactgtaggataggtagttaagctatccttatctaagctacccttacttaacctaacctgtgtctccattttggatacattttgtatacaatttccaataggtttaagactagctgtttttgacttgtcatactctagctgagccttttctgactggtataaggttgattgaaagcggtcagactggatatagttgtgaatccgccaatgacggataacgactacaccactatcaaagggaatcaagaacccttttgcaatcagtaatttcatatcatcatcactagcgccaatagttctctgaatcgtctttgccttatctataaagccctcatcatcagctcccatgttcaaatggaaatagagagcttgggatgatagtggcatttccaaaaaacggtcagtctcagtgatttttctactaaacattctgcgttgtgccatcatcaacctcctttgttagatactcataagctctcttataagcgtctaagtaaagttcaaagacatcattgacgtatcggccagcccttgatagaaattcatagacctcatattcttccatatcttcgctaaaacgttcaaaagcctctggaagaatataagtaaatcctttatcttcgtcaaaattgtcaaataattgatcaagtaggaattcatcatcaaaatctaaatcatcataatcagcaccatcaaagaattcattgagaatttctcttttagccttgtcagtatcatagtaatgaactggcctacttgaacatagtaacttttcaagaaaataccccagatgaccagtatagtgattgtagaatgtgtcccattcacccatattgtagaaatttcgtgcaactaattccccaaagtctcctgtgatagcaagggatgaattttttctatcgaaaatgtaacgtaagttatactcatagcccttttctggattgtaatagtcaacaatggtgactgtatcagattcgttttttacagcaatatggttgctgaaatagtggtcaaattttttcatttcattcctcctcaacgctagaaaacttggtatattccttgtggaaatacagcttgactgtgccaaggtttccgtgtctgttctttctgatgatcagctcagtgatgtcgttttctggctgaccttcttttttgtcttggtaataagcatcacgatagaggaaggcgacaatatcagcgtcttgctcaatgctgcctgattcccttaagtcggacatgataggccttttgtcgtttctttgctcaaccccacggctaagctgtgatagtgcaatgactggcacttttaattccttggcaataatctttaactgcctagaaatctcagatacctcttgctgtcggttgtcagaccgtgacccttgaatgagttgaagatagtcaatgactatcaatccaagtccgtcagtctcttgagatagcctcctagctcttgctctgatgtcagtaatcttgactccagctgtgtcatctataaagattggagcttcagcaagctgaccctgtgcatagataagacgttgccactcattaaccgtcaaatttcctgttctaatatgatggttgatgattgttccttcagctgacaacatccgctcaacaaggctttcagcccccatttcaagcgagaagacggccacagccttattggacttagttgccacattctgagctatgttaagagctagggctgtcttccccatcgctggccgtgccgctaagacaattagctggtcttcatgcaagcctgttatcagcttgtcaaagtcataaaatcctgtttcaataccagtgatttgactggtattgtttgagcgttcctcaatctttgaatgattttccaaaaggacatcatggataggtctgaaactactcttgttactggcttgactaacttcgataagtgatcgctcagcttttgcgataatctcatcaatatccatgtcctcatcataggcattgccaattgagtcagacaagttgtcaatgatagaccgtagctgtgcttttttagcaacaatcttggcataatgctcagcgtgtgagctggttggcactgcattaacaatctcagcgatgtagctgataccgccaaccatgccaagttcatccgtactttccagcgttgacttgattgtgacaatatcgatggcctcgccacgatcagcaaggctcaccatggccttaaatagaatcttgtgagctggcctgtaaaagtcatttggtttcagatactcagccacctcaatcattttttcaggtttgataaaaattgaaccaagaaccgactgctcagcctggatatcgtgaggcaatacttttaattcatccatagctttcctcagtcaacaaagacttctttctttgtttcagggtcaatgtcaacacgtcttccagtcttgtagtcaatgaagcctcgttgtgggatatattgagcaatgacagtcccagctgtctgtttgttcttgagagcttttctgagcttgatatttgagataagagactcaatcagggttactgaaataagtgtgcctactgcgataatttgtaaattgttcatgatatagttccttttgttctttcttagataacagttctttgccaattcttgtgataccattcaatgacttcatcacgagggtatttctcacgagcatttggaatcctcggaaaatccttatgacagttaaagcgttcatcaaatgtcccagtatctttagtacctaagagcattaaagcgcattgagacttgttgagttctaaaggaaatctatacttttcgtctgtcacaacgtgcattactttcatcgttctgtccattagaccagcttcgaactggtcaagcatttgaatcattagatcattcattatgcgtacctccatttatatccgtgagtctgtttttggtgccccattgctgttgctgttattctttgtgacgagatacctgttttcattgatgcagattttattgagtcaaacgtgtttatgaattccccttcaagtgtaaattgttctacaggtttacaacgacctaaagatgatttcgttgttctattcccatgattagcattttccttatctgtcgcccattctaaattatctactctattattaagtttattttcatcaatatgatttatcgttcgcttattgattggatttggtataaatgcttcagctactagtctatgaactcttatcgacttccttaatccattgactgaaagtgtcactattgcatagcctgaagataagctctgttttaagatgcgtccttttgtttttcttgttctctgttttgcattgactgttctaccaatagaccgaacacgaccaagattggaaacttgataatatcctttaacaattggtatatctttccaaacttcgttcattgtgatataatcctcttgtatctttatatatgagcctgattgccgtcaggcttttttgcgttttacagttcataagcgttcatctccaaaattttcattttggtatttgtgcttggttcccatgtcatccagtaagataatgctgcttcagcaaatttctttggcaacatgtcatagcgattgatattgaaatggtctttaaaatcaacctcagcttgtctaaagaccgactgtgcgaagactttatcagcataggctggactgtccattccacctagacaagagacaacacgagcttttctcttcttcagtaaggcttgagcaaagctaggatgaattggttgctcatttttcagataatcaacatcttgagccaatgccaactggtgctctttcagtttcttctgtccagtaaatagagcgatgaaagcctcatctgatagattttcaggcacataagctccctgttgccgaatctgtggcaatacctcgctagtgacccaacgtttgaattctttgacctgtggcaatttactggataagataagtgagtaaagaccagattcattgatgataatagtttcttgcatgcgacctaaattgtctgtgatgccctgttttagggcgtcatcctcatcaacatggagtgcaatcgcatttcgtgattttgaatagcctaaaatatcagccacgtctttcccaacaaaccaaggctcgttgttaatggttacagtacggacttcctgcccgtgaaaaacaaaaatttcgttcattcttaatcctccaacctcgtccagctctcatctatgtgtaatacatcagataccttatttttgagtttgtcgctccctttgccatatttcagcaattctgagatagttgccttagcaacaccacaagaacgagctagatgtgtttgtgtcatctgttcttcattcagcttatctttcactagctgaatccattttttctgttgttgactcatatttttcctttctagtttggtataattgacttgaaatcttttatgaaaggaggtcaagccatgaatttgaatcaaattcgtatcatagaggcatgccataaatttctaattggcatcacaaatttcgaagaagagttacaagatgacgttctcgtctatcgttacaaaggtaaccttgtcagctttgaaacctatcaagaatatgaacaacggtcatttgtagactataatctaaaatatggctatcttgatgacactagaacttacctagatgacagagctgatttgatagcagctttccctagcgaagagcacttgagagccttgcaaagagttaacgatgctgaacaagctcgtgtgcaaatctttaagctactatctcaggtcaatcttgactctctctccgaaaaaaattccaacatcaaaaaagataattttggatatgatttcttcaattttgcaactaaagaagaataccctgtttatcttttttcagatgatgaatcatttgagctagttgctatcagttgatacaacttcgccttcaaaatcaaatgacttcagttcgtgagctagttcttctagctcgcgggcttttttattgaactctttactaagttcaataaatttatccatgttagtaactttaactgtcactgtcattgaaccgattcccattcatctaccctcctttttaaattattaactaaaaagttagctaatctcttgactttttttaaatctagttttagaataagagcatagagaaaagacctactaaaagtaaggtttgacctaaagaaagcagacgccaatcagttttattaggctttattttttagttgtcttgttcgctaactctttagcttacgaatattattttaaacctagttttaatttttgtcaagaattttatatctagttttaaaatatttttttcgtatgccttagaaaggatacgatatgtctgttttaattgataggatacgtgaactcagtaataaaaagggaatgtctcttaatgacttagaagatacacttggctacagtcgtaattctctgtatagcttgaatgaaaattctaagatgggtaaaccaaaggaaattgcacagtattttaatgtctcactagattacctactaggtctaacagataatccacgaattgccagcgatgagacagctatcattgacggtcaagttgtggatctgagagaagcagctgcccataccatgctgtttgatggtaagccacttgatgaagatgatatagattttattacagcagtcctgtctgcacacttcaaaaataaacaaaaggattgattgcctatgaaactagaccaactctgtaaagagtttggagtggaattgtgcctgttcgatgccagcgactggcatagttcgggattttacaatccaataaccaaggtcttaggggttgatgtgaatctgtctgagcaagaacaaaaacaagtcgccctacatgagttacagcataaaaatcactttccatatcagtatcagctttttagagagagatgtgaactcgacgcaaataggaatatgatccaccatcttttgaaggaagaattggaaatcgctgaggaccacactcaattcaattacctggtctttatggaaaagtacaaattaaagaccatagctgatgaggctatgatcaaggaagagtatttgaatttagttggataaaatacgtgctcccctgaatcacgaataaaagcagggtgggaagatagttgttatggcattatttggtggcaaagacaaagaacctgaagtagaaatttttacagctgagccaaacgagcgagtttttgagtttaagaaatcaaagacgatagtaagaatagatgactactttatcagaattgcaagaaaaagcaacatgtcaaatatgcttctacatggacttgatggcgaaaaatcaattttgttatcagcaataactgcatatcaattaaaagagccaggggcaacggttggatatttacaattggtatatcctggatcagcagatactaaaggtggtgtctttgatgctgttaaggatgagaatacagtcacttttgtcaaagaagataaacaagccatcttagaattgaagatagcaatagaaaccgcattaaaaaataaggttcagaaataaataaaaagccctacgctcaactttggacggtccgagcgtaaggcgaatcgtataagaaaagttgccaatctggcaagtcttttcttgtactcattttatcagaaatgaggtaaaaaaacaaatggcatcatatcgaaaaagagagaacgggctgtgggaataccgcatttcctacaaaaccatagatggaaaatataaacggaaagagaaaggtggttttaagaccaagaagcttgctcaggcggcagcaatcgaaattgaaaagaaattgacccaaaacatcttgacaaatgacgaagtaactctatatgactttgtcaagacctggtcagaagtctataagcgtccgtatgtaaaagataagacttgggaaacctattcaaaaaactttaagcacatcaagaactatttccaagagttgaaggtcaaagatattacaccgctttactaccaaaaaaagttgaatgagtttggcgagaaatatgcccaagaaactcttgagaaatttcactatcaaataaaaggggctatgaaagttgctgtaagggaacaggttgttacctttaattttgcagaaggtgcaaaagtgaaatctcaggtagagcccaaaaatgaagaggaagattttttagaggagcgcgaatataaggctctcttggcccttacaagagagaacatccaatatgtatcctatttcactctttaccttcttgcagtcacaggactgcgtttttctgaggctatggggctaacctggagcgatatagacttcaaaaatggcattttggatataaacaagagttttgattactcgaatactcaagattttgcagatctgaagaatgagtcatcaaaaagaaaagttccaattgattcaaatacaatagatattcttcgagaatataagaaaaatcattggcaagctaatatcaagaatagagtgtgctttggtgtatctaattcagcttgcaataaactgattaagaaaattgtgggtaggaaagtcagaaatcactcattacggcacacatacgcttcgtttttgattttgaacggggttgacattgtgacaatttctaagctccttggacatgaaagtccagatattactctgaaagtttatacacatcagatggaagcactggctgagagaaattttgagaaaatcaaaaatatttttttagtcgcataatttggggcgaatttggggcgaaacaaccaaaaaccttgataaaccaaggttttcaaatccgtctaccgccttaaatataaaagattttatccaaagataacaaaaaatcaacgattgttcgttgatttttttgttatcagaattatttttttaaatccaataattgataaggtatagaagattgactatctcttaatgaatagctttctaattcattgacattatcccttaaaatttgagactctttagaactaattaaaccgtccctttcaaattcagagattgttctgcgttccaagtaatatcctcttagggtttcatttaaaatatctggcgttatgcgtgcaatgacacgttctacaaataaacctgatttaattaattctgcgtctcgaatgcgttcattttgtaagaaatctatcaaagttgcattataataaccttccatatcttctagcgtttctaaaatgaggtcattatttgataagtacaaatctgttaagtgctgacgattgacttctgctaacaaccgtttcctgtttttgaaatgttttttccgatttcgtattccttgtccaaatgttaaaaactcatgaacaataccacgaataacacgcataagaatcgttaaactataagtgatatttgacacaaagctacgattaacttggcgttctaagtattttaaataacgttggtaaatacgatattctttgatagaaatattgccataacgataagcagcttcaagtccatcgctttctatactaagcatcatcagttgcaattcagctaagtccttcttaatgtcactagattcttgttctaaaatgagatgacgaatacggctattataattatctataactgcataaaatgaagcttgattttcagaactcttaccatcttcttctaagacagataatacttttgttaaaatcgatagacgtattaaataatcatctttcacctgtaagggaggcgctaactttggtaatactaaaagtcccgttaaaaaactcattagcgttactgcaccaacagtgaaaagaatcaaactataccccaactctcctatgactgagtgcttgggtaataagagtattgttgctatggaaacacttcctttaactcctgaaaaagtcaacagttgaatctctctccaatactttttaaatgatttatggtatttgaaagatctccaagcataaaagcaagaaactgctagaaagcgaactagaaaaagtgtgcaagtaactaaaacaacaatactaataagatcaaaattactataagcgttacttgttaaaagaggaccaatgatacgtgtcagttctcttccaaatattaagaaaactaaaccatttaaaataaaatttaaggtttcccaaataacagaggtaacgcgatctacttgagcatcaaagagagtcacttttttcaaacgatttgcttgcattactcctgccactaccaccgcaataatagctgaaaatcccaacaaatcagcaacgaaataagcaacaaaaggtaaggttaattccaaaagtagagcccctgtaacatcagcagcatcaaatttctctaggacagtgagacataacctcattagaaaagcaaaaagcaagccaattaaaaaaccacccattatggccaatgctaacttgagactagcttttgctaaggagaaataacctgttacaagggctgttaaagcaaactggaaggaaactagaccactagcgtcatttaaaagaccttccaatttgaggatattttctgcccgtttaggaaattgaaacctcttagcaatcgatataaaggcaacggcatctgttgggcctaaggctgctccaagcgcaaagcatgccgcaagtggtaaactaactggcaaaaggtgccctgctacataaccaacgacaatagctgttaaaaataccgttggtaagattaagtaaagaataatagcccgatactttataaaactaccaatatcactttcttgaccttccctaaagttcaaaggagcaataacaaaggcaaggaataactcaggatcgatatggacttgtgacttatgaaaaactaagccagagagaatcccaaagaccaactggataaatggtaatggtaatttaggaaatatcctattgataacattagataaaatcaaaaacaggagaaagctgactattagaatagtttcttccatattattcctccttcataacatctatcaattctttcttcaatttctcaattttatcatcgatttttttagtatcttctctctccaatcgacagcgacatctttctttttcaagtattattaatttcttctttttcttctttactttacttaagtgaacatttgaaaattcttgatttttagaagaaaggtatttatcttttagtcgattcaattgttcttccaaagataattgagacatcatgacctcctatttaatgaccaaattattaataataagtattttttctttcatcggctatctctagtataacacgcatttcttaaattgatagattttaagaatatcgttgctcattatctccatatgtggtagactaacaacaatttaaataggaggttaaccaatgaaaaaattaacaaaaggcagccacattcgtgttcttagtccctcttcttccattgagcgtctgggtggttttgaggctaacctattagccaaagaagtactagaaaagctgggatttcaagtgtcattctctaagcactatctagaaaatgatatcctctattctgcttcgattactagccgtgtagaagatttacatgaagcatttgccgacccttctgttgatgccatattagcaaccattggcggattcaattccaacgagcttttaccatatttagattatgatttaatctctaagaatcccaaaataatttgtggttactcagattcaacggccttccttaatgctatttttgccaaagcaaaaatccaaacttacatgggccctgcttattcttctttcaaaatgaaggaaggtcaaccttaccaaacacaagcttggcttactgccatgacagaaaaccactatgaactttggcctagtgaagaatggtctagtgatccctggtatgatcccagcaaaccacgccaatttttcccaacagaatggaaaatttataatcacggaaaagcttccggtacgattatcggaggtaatctctctacgtttggcctacttcgaggtactccttatgcaccgaaaattgaacgctatgtcctcttgattgaagaggctgaggaaagtaatttttatgaatttgaccgcaaccttgctgcaattttacaagcttatcctcatccacaagctattcttatggggcgctttcctaaagaatgcggcatgactccacaagtctttgaatatatcctttcaaaacatgctattttcaaggaaattcctgttatttatgatatggattttgcgcacacccaacctcttttgacagtgactattggagctgagctaagcgttgacactactacattatctctatctataaaagaataaaaaaatactcctgctactcatctgagtaacgggagtttatcatttagagttaccaaataataacacgtttttcaactggacgccacatgttatcaccatctttaacatcaaactctttatggaattcttcaaaattcgttactgtaatattagttcgccattgtgctggggcgtgaacatctacactagctaacatttgcatatactcatcacgtgccttcatacgccaaattgtcgcaaagttaataaagaaatccctcgctgaaaaatctgactcacgctgcgcagcttctaaagcacaagcaactccacctaaatctgcaacattttctgatactgttagtttaccattgacttttgcgccataagattccagtccatcaaactgctcaactactttatctgtaagttttttgaaagcttcaaaatcttcatcagtccaccaattattcaaacttccatgttcatcaaatgaagctccattagtgtcaaaagcgtgtgatatttcatgtgcaatcactgcaccaattcccccataatttgctgatgaactttgctctaaagcataaaatggttcttgtaaaatggctgctgggaagacaatttggttttgttgtggatcataatacgcattgaccatgtgggcaggcatatgccattcacttctatcaactggtttattccatttactccaaccataggctattgaaattttgtctaaattagtagcattttcgacaagcgatagtttaggatcaatgatttttttagtataagtctctggtagtttctcagggtatccaatatgtggtgtgataacattaagtttcataatagctttttctcgcgttgactgtgcaagccaatccgccttttctaagcgtgacttatagacatcaatcatcgttgcaatcttatgctcaacatcagctttagcttctggagagaatttttctcctgcataccacaaacctagagcttgattgtaaggtcctgaagcaaggtagtaagctgcttttttcttatccattgcttgtggtgtgcctgataaagctcgactgtaaactcccgatttgatacgaatatcatcagttaagtaagcattataggcattcgcagctgataaaataagatctgcctttaataattcccaattagattctgagtaatagtcagatgcaaattctgtccagaaacgttcttcaggaacaataactttatctggtttttgtcctaatatcttttggaaaatagcatctaatggaagttcaggtgctaattttgtgaaatcttcccagttataaggatggtaaagtttaacatattccgaactctcttcgcgagataagacatattgtgccaattttgcatccaatgctaaaaccttatccaagatatctttaatttcctgttctgaaaggccaaacaaaggcagtaggtcttcttgacttttacgccaaaaagcaaggagttcctttcctttttcattatcttcactataataagttgtatctggtaaaataatcccaggcgcttcagcccaaagtacattcaattgagcattcataaagtcaggagccacaccaaatggaaattcatttggtttaccctctagttcatattctgcaacttttgatgcaaactcagagaaagattgtaggcctttatattcttcaattaatggtaatactggtgatactcctacctcttcacgtttttgataatcagctgtcattttatgaaaagcaataaaatgatttaaaatcgtatcacttggtttattttcatcagccagccacttatctgtcgttgacagcattaatgcttcaatgtcatcagcaagatcagaaaaaccacctgtccttggtttgtcatcaggaataacagctgtcttagcccactccccattaaccgcttggtaaaaatcatcttgatattttatcattattttctccttaatatctcatatgtaatctcttacagtctaacagaaaattcagagtttgactattaaaaatactctcatattggtgctttctctaaatatcattttgttatttttgctatactataaaccaacaaggaggttgttatgattgaaaaatattataattgggcaacgcttggaaccggcgttattgccaacgaattagcccaagcactagaagcacgtggacaaaaattatattctgtagctaatagaacttacgacaaaggacttgaatttgctaccaaatatggtatccaaaaagtttatgatcacatagatcaagtatttgaagaccctgaagtggatatcatttatatctctactccccacaatactcacatctcatttttacgaaaggctttagcaaatggtaagcacgttctttgcgaaaaatctattactttaaacagcactgaacttaaagaagccatagatttagccgaaactaaccatgttgtcttagctgaagccatgactatttttcatatgccaatttatcgccaattaaaaacattagttgatagtggaaaattaggaccgttaaaaatgattcaaatgaatttcggaagttataaagaatatgatatgactaaccgttttttcagtcgtgacctagcaggcggtgctttgctggacattggtgtttatgcactttcttgtattcgctggtttatgtcagaagcacctcacaacattacctctcaagttacatttgcaccaacaggagttgatgaacaagttggtatcctactaaccaatcctgcaaatgagatggcgactgtcagccttagtttacatgcaaaacaacctaaacgagcaactatcgcttacgataaaggctacattgaactttttgaatatccgcgaggacaaaaggcagttattacttatactgaggatgggcatcaagatattctcgaagctggcaaaactgaaaatgccctccaatatgaggtagctgatatggaagaagccgtttcaggaaaaactaaccacatgtacttaaactataccaaagacgttatggatatcatgacacagctacgtcaagaatggggatttacctacccagaagaagaaaaatgaagagagcttgacaatgattgtcaagccctttttagttaatatacactacattttcttaaaaaataggcgtttaaagaaataaatcataccaactgctaaacttaaaatagcataaacatagaaaactgcatttatttgtcctagtaaatgatcaaaacaagacagaagaatagccgcactagctccaccaatattacaaaatactaaaactaatgtcgttgcagaaccaaccaacgaatattcaacacggtctgctactaggctaaacacagcagtgaccatcaggctgtaaaggaaacctgatgccatcgcactaattgttagtaccattagattagaaggcaatccaactccaagcaatgttaaagaaaataagacgaggcagattggaattaattgtttatgaaacatagctatcaactgaccaaaactcatacctgctattattcccataagcatcatcgcactaagaacaagactagcttgagctggcgtacccaaaccaaattctactactagcagaggtatcctaagattaatcccagtatttatagttatgacaaatcctgctaaaatagctaaggcgacaatataagttaaatcagctttagggattttttgacctttagttttaatcttgtcatttgtatctttcaccactttcttaggcgcaaaaacaagatatagaactaagattggtaaagctaaaaaataaatcataaatgatttggaccaaccaaaagtcaacaacagcccaactaaagctgtcaaaccagcatttcctaaaacttcaaaggacccccttaatcctaagagttttcttctttctttgccttgataatattcactaatcacactaatggccctagtattaataaaaccaataccactccccaataaaagacgcgatacaaatactaaaaggtagttctgactgacaaccggcaatcctccccctaatgctgttagcaatagcccaaagataatcatatgtttctcagaaagttttttacttaaccaaggtgtgataagcaagatgaagataatagccatcgaaggaattgaaaacaataattcaacttggggtgatggtaagcccttatctctataataagatatcatttgtggtagggctggtgatgtcgaaaaagttgatagcaagataagtgataaagagagtaaacttagcttctccataaagattttcaagtgacaatacctctttctgatgtctttttttagataaataaagtataatcaatattaaactagaaatatatgacatatgtcctaaaactatctcaaatagggagtcaatacatggatatagaaaactactgccaagactactgtttggagactatctttccaaaacattatttcaaggatttacaagtaatcaccctaactgccggccaatccgtctgtaaacagggagaacaattagaatacttgcactacatcgtcaagggacgttttaaaattgtacgtcgactctttaacggcaaagaacatattttagatattaaaacaaaaccaacactgattggtgatattgaacttttgactaatagacaaattgtatcatctgttattgccttagaggatcttacagtcattcaattatcacttaaaggacggaaagagaaactgttaacagacgcaactttcctcctaaaacttagtcaagagctagctcaggcttttcatgatcaaaacatcaaagcgtctactaatctagggtataccgtcaaagagttacttgcaagtcatattttagcaattgaagaacaaggttactttcaacttgagttaagtagtttagctgattcgtttggcgtcagttatcgtcatttattaagagttatccacgatatggtcaaagaaggccttatccaaaaagaaaaaccaaaatactttatcaaaaatcgtttcgcactagaatcattaaatattcagccatgaagcgtagctttatcatttaattattttatgctaaactaaatcagagaatacagttaggagaaaatatgtctgctattgataaattagtaaaagctagtcatttaattgacatgaatgacattatccgtgaaggcaatccaacccttcgcaaagtggctgaagaagtcacattcccactttctgagaaagaagaaattctcggagaaaaaatgatgcaatttttaaaacactctcaagatccaattatggctgagaagctaggcttacgtggtggtgttggtttagccgcaccacaattagacatctcaaaacgcatcattgccgtccttgttccaaacgttgaggatgctcaaggaaatccacctaaagaagcttatagcctccaagaagtaatgtacaaccctaaagttgtatcgcattctgttcaagatgctgctttatctgacggggagggatgcctatcagtagatcgtgaagtacctggctatgtcgtccgccacgcgcgtgtaactattgaatatttcgacaaaactggtgaaaaacatcgactcaaattaaaaggttacaactctattgttgttcaacatgaaattgaccacattgatggtattatgttttacgaccgtatcaatgagaaaaatcctttcgctgtcaaagaaggcttacttattttagaataaggacaaataacctagagataattttctctaggttttattttttaatagcaaataaaataagaaatcttttttaaaaagtcgactctttccaaaacatctggcaatctacaatctgttggttatcgacggagtcatctccttcaatacgattaatcaaaatctgtgctacttgttcaccttcttcataagccggctggacaattgttgacactttaggagatgaaaagtctgtccattcaatattgtcaaacccaactaaaccaactcgtggcatatcaaaattgagattcttcatggcagtaaaaaccattggtaaagcccaacaatttggtgcaaatactaatgtctcctccttatctggaactaccgcttttagaaagtcttctatatcactttttgaatgatcatcatcttcaatcaccaaagtgtcataaccgaaaccattgtcctttaaagcatccatgaatcccgaagctctctcaatacgtgtactaagcaagctcgtatcagcagtaatcataataaactttttataccctcgatttagacactcctgtgtcatatcataaacagcatcatagttattagccttaacccaactcgtcttatgttcataaagttgactatcaaaaaataccattggtttctttttttcttttaaaatacgagaatactttcgaaaatttgatgtaggctgaataatgaaaccatcaacacctaaatttaacatattttcaatataatcttcttcacttttggcatcgtaattactattacccacaataatttgatagcctttttgtttggtgatgtgctcaattccttttacaatttgatttgaaaatgtgtttgttatatctccaattaagacacctagtagttttgtttttttagaatttagacttcttgctatcgtacttggtctataacctgtttcatcaatcacctcttgaatacgttgcctcgtctcatccgacattttttcaaatttttgattcaagaaaaaagaaaccgttgttttggaagtttttgataattgagcgatgtcattaatggtcatttttttagacataacaaacctcctttctaattttactaattttatttttttatggttaatatagtactagtatagcataataatagccctcttaattttttaaacgactcattttgccattatttttatcatatacaatgacttttcctttgcattttatcccttgcatcaaatagagtttatccccaaagataatatcatccataagcactccaattaaataatgaaagtcttgagacctaatatcaaatgcaatgctattacttagttccttatgactgttcgtttgcactaaaggaacatatttcacctgacagttccgatcaactatcaaggtataatccatcacctcatcaacaaattttattttcttaactaatttatgactttctgtcaattgattataccgcttagaaataaggcaatcttctagattaaaggtcgtaggacttactaatttcaagtcattaacaaacccattttcataaatgacctgatcatctaaaatatattgatttgttaagacatgctctcctggacaactcaccttatcaataactaaggtaatggcctgcggtaaagttaacaaccatcgcttatggtaatagatatcagaagctctttggacatgtagttgtccttcgactaaatggtacctatcctttgaagtcaactgacaatagtcacattttggataagaattgtatgtccaagagtccttgatcatttctaagggttgcccatcaagggtacatgttgaatgactagtcgaacgtttaaaatcataccttagttgttcttctttgtaagtatatcttcctgcatcaatgaaaataggtttctttttatcatagagacaaacactattattatcactatgagtatgagcgctaccaaatggaccgttcttaaaaaatatataacgcctatcatcacgtaaacacacatgaccagaatctggaaaaagataagcagactctcctattgtcgcacgcggtatttcttcaaaaagataaattgatggcttcccaaacaaaagtaaagtttctaaattaacattatcaaaagaaaatgattttgttttagaagatttcaacacaagtgttgccaaagttagaatatcacgagtatcggtcacatcactgtcccctatagctagttgacaataatccggaccagtcatagcaattagataggtaaccattttttcaatagtttcttctaatggtagataatatttaggcgcaaggataactagttccattaaggacttcaagacttctacatgatacataattgattgttcatactggctcccgtcatctaaaatttgaagcttgatttgaagtaataattcttcttcagcaaaactctgaatttcaggtagatttaattcatcttcataatagtataaacacgccaatattgctgttgtttgtaaaattccccagttacttagactatctttttcacgataatagtccctcatataagttatctgctcccgtaaactagttaatagtttaatttttttagtttctgttattaatccaaaataatctaaaaaaatcaaaactttgagccatgacatgcaacgtatcccagtgtcaatagtacgacttaccgccccttctggctttagtgtaaattgacaatcaatccaatggtacataaaatatttcatttgtctaaggtaagacttatcgccttcaacaatgtagaccaccaggaatttaaaaagataagtttgacgatttagcatatacaaccattctggatcatctgttactggcttatcccactccaaaggatcaagacaatatgctttagaacaaggttccatatcccaattatcattaaatacaaaagtgttcctcatcatcaaattaacagaggctttcatttcttgataggcattagattggtatgttttaatatacttttgacaaaattccctatcaaaatccttgaatttattatataagcgatctttcatttttttacaaaacgtcctcgtccgatataaaaaggactatgtcattgatatgtcataatccttatttatcaaaattttattaagctaaaatacctaaccagctaccaaggataccaataataactgtaaggataactaacttataagttgtccattttttatttttaataaggtaaaacataaggaaagtgtagagtgctggaagtagagctggtgcaattttatcaagcataccttggacagtaacaatcttttgcgttgtactagttactttttctggagcaaaagtgtaagggattgtaagcttaacttgtgttgcagctaaacttgagatgaccgttacaccaacgatattagctgcccgtgagataactgacatttgttcactcaatttatcaataaaactggtcccaagacgataaccatacatgccagtaactaatttaattcccgttaaaatagtattcatagccacaaagaacagaatcggtcccatcaccaaaccatctgtcgctaaagaggctgcaatcgttgagaacaagggtgctaagcaaaattgtgataaagaatcaccgatacctgcaagaggccccataagcgccatcttaataccgcgaatttcttcttctggccgctcattatcaagcattgctaaatgtaagctagttacaaaaggtaagaaatgagggtttgtattgtaaaactccacattttcttctagagctcccgctaaagcttttttgtcatctccataatattttttgagagctggatatatgacattagcataaccaagaccttgatagttactgtaattaaagccattttgtaaataaaaggcacgtaaagctgttttagtgtaatcactttttgctaattttttagatccagtcatcttggttgtctccttctgtcttagtttctttagtaggtgcagctggttttctgaaaatatcaagcaaagcaaatattgttgcaattatagctaccccgatagttggaaccccaagcacactgttagtagccactgatgttaaaactccgtctccatttgctgttggagttagaactggcaaaccaaaataaacagctagaacatatccaagtaggatataaggaatgagttcttttttagccattacagagagaatcatcgcaaaaccaattgcaggaagcattttcccagctaaggttagaccattaagcaaaacagggggaatgagagcaaataaatctgtcaaagtttgcgttgaaagagcacccagtactcctaaaccaaatcccaatccagcgaatgcccaaattgtaccatttgctgcaattttaaatcctcggaaattacctgcttgcaaagcttttttagctgtttcaggcgcccctgcaaaagcagtataagttgctgtttgaagaaattgaataccaactgcaattggggttgataatgcaagagcagcttccggtgtgatttttcctttagttccagctgttgtaatagccatcaaagttccaaaaatcccaggaccgattgggtttggaggaactgtccctcccgctcccacaccaaatcccatgtaagccagttcagatattgctccaactgccaaagctgtttgaatatctcctaaaataacaccaacgcctagagagagaacgatacaacgatttgtatagaggccaagcaacatgccactaaaacagaaagccgtccacagtccaattaagacagcctgaagaatactaatatccatatttttctcctttatatgatagtaagtttgtccaactaaatataatctaaaatattaacttccacagcaccatcgttacctgttggagttgttttagtattaaatgcaatgtgatattcttggtttaattttctaattatctctttatccttcatccctaagaagatagagcgacttacctgctctttaccttctccattatgaatatttccaatattaatctctttaattgggacgccccctgctacaagtctatagacatctttcaaatctttaacaattataaaaatcgtctgtgctgggttggccttgtgaataatatcaataactttttgaatatcaaaaaatcgcaatgctattgattctggcaccaccgtcttcattaacgtttgttgaagatgatctttggagacatcatcatttgccacaataacagtattacaacttaaaaatttcacccaaagttgtccttgtccatgaataagacgctcatcaacacgtgtcattacaatatttggtcctgctgccatttctgacctcctcgttttctattatttattgtttattttgttagtaaaatactcttaccaataaagttcccagtctttatagaatcttattaaggcttctaagtaataataatctccccaaatattaccttcatctactcctttacctgaatgccacgaatacacaccgtgcaatagaagaggacgtcctgctataagttcattattactatactgttcaatcagactacgaagcattgtatgcatagcatatttgtatgtctctttatcaggatctacttctggtaaatatttaagcatctcatgaattccacacacagccgttgctgttgcggatgtatctctaggctggcccgagccatccgtaaaaataaggtcccaataggataccttgtcttcaggtaaacgatttagaaaatagtttgtcatacctttaaaaaggataatctgctgataatctttcattttccggtaactaagcggaataccgtagatgccccatgcttgccctcttgcccaagatgactcatcactataaccctgtcgtgtgacaccttttaacggttctccagtttctgggtcgaaataaaaagtatgaaaagcagaagaatcatcacgcaccacattgttagctgaagcgtagaagtgattcaccgcaacttgtctatacttttcatcacctgtctgttcataagcaaaaaataagagttggatattaagtaagcaatcgataattaagcgatagtgttccttatacccgagttctccccaagcctgaataaatccacctttttcttgatagcgctccatcaatttatctgcagcttttatagtggcttctaaagctttaacatcaccattgatacgatattctgctgtacaagatggtgtgtaaagaaatcctaagtcgtggtgatctaatgctatacgattattaatacgatttagaaatgacaatacatttttgtgggctatgttttttaactttttatcctgattatactcataagctaaccacaagcaccctgtccaaaaaccatttgtccattctgtgttatccataactttataaatattattgaatgttgcaggcgttggatactcttcaccaaagtaatcaatattaatataaagttgcttcaaggctttttcaatcgcttcctcaacttcaatcttagttaataatctactgtttaaaaaacgctttggattttcaattgactcaaccttgaccggttttattttcatcattattaaatgcctccctcaaaagttgcttctgcagtttgtgtagcaaggcaagtagaaaaatcaacaattccttcatgagatgatgttataactttatcaacaagatcatctacatgttcaaacatcgttctagataaaacagcttccattaacattgaaaggttcaagcccgataaaacttttatctttttatctgtatattctactgataaggcggaagaaacattgaaaggagtcccacctagcaaatcagtcaatactaaaatttctttgaaatcgataacctctctttgcaaagcaactctaacatcattagaagacatgcctgcaataaagttaataccaacaacatattcctgatgcccagcaataagttctaaagagcttaaaataccatctggaaagttgccgtgtgctacaataataatttttatcatattttctcctcttgagtttaccggtttacttttataatcagattatagcgctttcatttttaggtgtcaacatcttttttatattttttgagcagtttacttgattttttataatgatgtcttttttatctttaagaattataacctagataaatctttgttatatatgttgccaagttttatagaagaagaactctatagttgacaaaaccggtttactttgttactattcatgtaaacaggtttacttcctgaatttttttacggaggtcatattatgactgaacaattcttaaaagacaacttttcactagaaggtaaagtcgccttaataacaggcgcttcttacggcattggtttttcaatagcaactgcttttgctagagctggagcaactattgtcttcaatgatattaagcaagaactcgttgacaaaggcatctccgcctataaaaaacttggcattaaggcccatggctatgtttgtgatgttacagatgaagatggaatcaacgaaatggtggacaaaatttctcaagatgttggggtaattgatattctagttaacaacgcaggtattataaaacgcacccctatgctagagatgagcgctgcagattttcgacaagttattgatattgatttgaatgctccctttatcgtatcaaaagcggtattacctggaatgatccaaaaaggacatggtaaaatcatcaatatttgctccatgatgagtgagcttggacgcgaaacagttgctgcctatgctgctgccaaagggggacttaaaatgttaaccaagaacatcgcttctgaatacggttctgctaacatccaatgtaacggtatcgggcccggctatattgccacaccacaaacagctccccttcgtgaacgtcaagatgatggttcacgtcatccattcgaccaatttatcatcgctaaaacacctgccgctcgctggggtgaggcagaagatttaggtgcaccagctatcttccttgctagtgatgcatcaaactttatcaatggtcacatactctatgtagatggcggtattttagcttacatcggtaaacaacctcaataataaaggagtaatataaatgaaaattgcattaatcaacgaaaatagccaagcaagtaaaaatactattatctacaaagaattgaaagcggtttctgatgaaaaaggatttgaagttttcaactacggaatgtatggcaaagaagaagaaagccagctaacttatgtacaaaatggtttactgactgctattttacttaatagcggtgctgcagattttgttattacaggctgtgggacaggaattggagcgatgcttgcttgtaatagttttcctggcgtagtctgtggattcgctgctgatcctgtcgacgcttacttattctctcaagtaaacggaggaaatgctctttcccttccttttgctaaaggatttggttggggagctgaattgaatctgaggtatttatttgaacgtcttttcgaagatgaaaaaggagggggataccctaaagagagggctgtacctgagcaacgcaatgcacgtatccttagcgaaataaaacagattacttacagagatttactctctgttttaaaagaaattgatcaagatttcttaaaggaaactatttctggggagcatttccaagaatatttcttcgctaattgccaaaatcaaaatatagcagactacttgaaatctgtcttagactaaagcgtctgttttagaaaggacttttatgtctaagattctttttttcggtgaacctctcattcgcatcactccaaaagaaaatgactattttgcagatagtatctcaactaaactattctatggtggctctgaagttaataccgcaagagctctacaaggctttgggcaagatactaaactcctctcagccttacccaataatcccataggtaatagttttcttcaatttttaaaagcacagggtattgatactcattctattcagtgggttggagaacgtgttgggttatattttttagaagattcctttgcttgcagaaaaggtgaggtggtctacgaccgcgatcatagtagtttacatgactttaggataaatcaaattgatttcgatcaattatttgaaggagtttctctctttcattttagtggtattacactatcattggatgagtctatccaagagataacactgcttcttttaaaagaagctaaaaaaagagagataacaatctccttagatctcaattttcgcagtaaactaatttctcctaaaaatgccaaaatccttttttctcagttcgctacctttgcggatatttgttttggtattgaacctcttatggttgactcacaggacactaccttcttcaatcgcgatgaagctacaatagaggacgtcaaagaacgaatgatttcgcttataaatcactttgactttcaagtcattttccatactaaacgtctacaggatgaatggggacgaaaccactaccaagcttacatagcaaatcgtaaacaagagtttgtcacttcaaaagaaatcaccacagctgtaaaccagagaattggaagcggagatgcttttgtggcgggagcgctatatcaactacttcagcactcagacagcaagacagtcattgatttcgctgtcgctagtgcatctttaaaatgtgctttggaaggggacaatatgtttgagaccgttaccgcagttaacaaagtactaaatcaatcgaaagacattattcgttagaagggagaattatgataaaatcaaagattttgttgcaattaatgcaaggaaaaatagttgctgtcattcgtggaaatagccaagaagaagcttttcaagctgctcaagcatgcataaaaggtggtatttctgctatcgaaatcgcctatactaatagcaaagctagccaagtcattgaacaactagtcacacaatatactaaccaagaacaagttgtcgttggggcaggaactgttctagactcagaaactgcccgaatggctattttagcaggagcaaagtttattgtatctcccgcatttaatctacagactgctaaactatgtaatcgttatgctattccttatttaccaggttgcatgaccttatcagaggtaacaacagcacttgaagccggttgcgaaataattaaaatattcccaggaggtactctaggaacatctttcatctcatcactaaaggcacctttacctcaagtacaaattatggtgactggtggggtaaatctcacaaatgccaaagactggtttctatctggagtaacagccattggtattggtggagagttcaataaactagcagctttgggggaatttgataaaatcacagaaatggctaaacaatacaaaatacagctaaatctgaattaacacaataaaaagacaaggcacccccacacctcaatcatgagacagaagaaaagaacttttataaagccatttttctgtagtaccgtttatcttaatcagactcattatctcgattttcttatcagaccgagataatttttagctaatcttcctgtagacataaccgttctacttccgacaactgatccatgtcttcaccaaagatatactacttgcccgcagattgatataagtagtgaagctcatcattctcatatcatttcagcaaataatagatttgatatcatttttatatccaaaaacttagcaatgacctatcaggcttacccgcttttcctatctcaacacagactaacttagctcctatcaaatacattttttaaacataattaaaaacatttctgattatagtttattagatttcaacagaagtattttttctgcgtctcagcttttgagtgtaccgttattttgaagttttgatagttgagtgatatcattaatagtcgttttttagacacgctaaacctcctttctaatttgactgattttattttttataacgactcgttttactgttacatctctttataatcacctatttaaatagacgcatttaaaatcaaaattaacccaagatttttattgaaaaacattttttaatatgttattatttatttattaataaattaggagatttttaaaaaatgaagaaaaaagattaaaattaacttgtgtcttatcatttgctgtagcttcaacattattcaacctatctgatttaaatatatcatatgctaatcaaaataatattcaagaaactaatctagttgaaaaaaacagtgaagataagtttattcaagagttaaataggtataaaacagagataccaaatttcaaaggttttaatgtttggattttaggtgataaaggctattacaaaaaccttatcaatttagaagaaattaaaaatatccaagctacattaaaaaaagaaagaaatgaagaatatgtctttgtcaaattaaatgggaaaatcgcacatgatacaaccgtattcttgatgaataaaaaacataaattacttaaaaatatagaggaatttaagacgataacccaaaaaaggctaactgagagaggaaagttcccatatgataccgttcattctacgtttgaaattaaggatgaaaactttatcatggaaagattgaaatcatcagggttatctatgggtaaaccagttgattatatgggcgtaaatggtatccctatttacactaaaacattatctatagttaataagtttgcctttgaaaataattcaaaagattcttcatattcttcaaacattaatattagtgaagataaaataaaagaaaatgaccaaaaaattctagatttaatagttaaatctggagctaataatcaaaacttaacagatgaagaaaaagtaattgctttcactaaatatataggtgaaataactaattatgacaatgaagcttacagagctagaaatgtcgacacagaatattacagagcttcagatttattttctgtaacagaaagaaaacttgctatgtgcgttggctatagtgtaacagccgctagggcatttaatattatggggatacctagttatgtcgtttctggtaaaagtcctcaaggaatatctcatgcagctgtgagagcgtattataatagaagttggcatatcatagatatcacagccagtacatattggaaaaatggtaattacaaaacaacgtattccgattttattaaagaatactgtatagatggttatgacgtttatgatcccgcaaaaacaaataatagatttaaagttaagtatatggaatcaaatgaagcgtttgaaaattggatacataataatggaagcaaatctatgttatttattaatgaatctgcagctctaaaagataaaaaaccaaaagatgattttgtaccagtaacagaaaaagaaaaaaacgagctgatagataagtataaaaaattattgtcacagattcctgaaaacacacaaaatccaggagaaaaaaacataagagattatttgaaaaatgaatatgaagaaatattaaagaaagataatttatttgagcatgaacatgcagaatttaaagaaagtctaaatttaaatgaatcattctacctacaattaaagaaagaagaaatgaaaccgagtgataatctcaaaaaagaagaaaaaccaagagaaaattcagtaaaagagagggagactccagctgaaaacaatgattttgtttcagtaacagaaaaaaacaacttgattgataaatataaagaattattatcaaaaatcccagagaatacacaaaatcctggggaaaagaatatacgaaattatctagagaaagaatatgaagaactactacaaaaagataaattattcaagcatgagtacacagagtttacaaaaagtctaaatttgaatgaaacattctattcacaattaaaagaaggagaaatgaaactaagtgaaaatcccgaaaaaggagaaacgaacacgaattaacctttcaaatatctacatcaaataacagaagtctctgtatcaagcgaattgtagcttttttgaatatactaaaaacactcctacctctattttactagaagtaggagtgttttttcattttagttcatagatgcagtgtcattgctatccttgcctttttttgtacagtattatccgatgactttaaagcggtcatcatcattcatgaattctttttctcctgtttcagcttcgattgaaccaaaatttagttgtccacgaagtttccaactagctggaacaccataaacagcttgtactgatgcatcaataactggattgtaatgttgtaaattaccaccaagtccaagttctgcagaaagggctgtccaagtatttactgaggcaatacctgttgattgctcagaccaaactggaaagttatccgcataaagaacgaattgttcttgaagagatttgacaacatcttgatcttcaaagaagagtactgttccctttgaagctccaaaactagctaatttttccttagttccagcaatagctgtctctggagcaccttgtactttcattgtttctaccaaatcattagcaaccaattcatcccagaacttagtaacttcatcattcaataaaatgacaacacgggaagtttgactattaaaagcagatggggattggcgaactgcctctttaataatctctactattttctcatcagaaacttctgtattgcgaccaagagcgtaaatagagcgacggttttttaattcttccaaaaatgacatattttttctccttgttcttcaatctcagatatcttactacatttgttctagtgacatatgaattagattaaagttatttattactatgtagtaattatattaccactatatcataaagtcaaagaatgtgactcacaaggttttaaatttttttaaaaggttaatcaagtcttcttgctctgtttctgttaagactgaaaaagcatcttctacacgtttaatatgctctggtagagctttttttatcacttcttctccttcagttgttaaactcaccaaaaaggctctcttatcattcggacaagaatggcgtaatacccatccctttttttccatatttttaataacaacagtcatattacctgatgtagcaagcatattttcaatcaattctccaattttcattgtgcctttagcatagagaacatccaaaactgcaaactgagttggtgttaattcaaattctttaaatgattctgagacttttccgtctattgttctaaatgcttttcgcatgacaaccatagatttaaccgctgaatttttaaagtttcccatttcatctcccaaacgtattttttcttattttatcactaattagttatttcaagcaagaatatcatctttgccctatcaaaagcagctggcaaataataaggttgagtagttactcaaccttattacttagaagaaatcatcaaaaagactcaactgattgtcttctggtaaatttcccaaaatacccatctcatcaaatttttcaactaaggtacttgagactcctcctcgtttacgaagctctgtttttgataaaaattcaccatcttcacgtgcccgaactatctgttttgcaacgttttctcccaagccttccatagcaacaaatggagggattagcgtatcctcttcaataataaagtcagtcgcatggctacgataaagatctaatttcccaaatttaaagccacgctcaagcatttcattaaccaactctaatgtcgtaaaaagatcattttcgacattcgtcgcctcattacgctgacgcttctcagtgatatccttcatgcgcgccttaacggcatcaagtccagcactcattgtgcgtaattcaaaagctttggcgcgaatagaaaaataagcacaataataaaatattggataatgtactttaaagtacgccacacgtaatgccattaaaacataggctgctgcatgggctttagggaacatatacttgatttttccacacgattcaatataccaatccgggacattattatcacgcattgcttggatataaccattacgctcatcttctgaaattttcaaccataaccccttacgcacgcgctccatgattgtaaaggccatctttggttgtaggccagcgtgcattaaataaaccatgatgtcatcacgacaaccaataacagttgataaggtagcaataccttccttgattaagtcttgagcattacctaaccaaacatccgtaccatgtgatagccctgacagttgcaacaattctgcaaatgtggttggatgggtttcgttcaccataccacgaacaaagttcgtaccaaactctggaataccaagcattcctgtaggagttccaatttgctcttctgtcactcctaaaacttccgtaccagaaaataacttcataacgtctggatcatctggaaggatatttgatggatcaattcctgataaatcctgaagtttacgaatcatagtaggatcatcatgtcctagaatatctaacttcaagacattctcatcaatatcatggaaattgaagtgagttgtctgccaagcagctgtcatatcatctgctggatattgaaccggagtaaaatcataaacatccatatagttaggaataacaacaataccaccggggtgttgacctgtagaacgtttaactcccgcagcaccagtcgctaaccgttcgacctctgcatcgttataaaatttattgtaatctcgttcgtaacctttgacaaaaccaaaggcagttttttcagctacggtacctaccgttcctgcacgaaaagcatattcttctccaaagatatcacgaacgtctaagtgagcagaaggttgatcatctccagagaaattcagatcaatatcaggaaccttatctccatcaaatcctaagaaagtttcaaacggaatatcctgtccatctttcttgtacaaagtaccacatttaggacaatttttatttggtaaatcatagcctgaaccacaagaaccatctgtgataaattcagaatgctgacaatttgggcaaacataatgaggtggcattggattaacttcagtaattcctatcatggtcgctacaaaactcgacccaacagacccacgtgatcctactagataaccacgttcattagaacgttgcaccaacatttgcgaagcaagatagataacggcaaatccattaccaagtatagatgctaactctttttcgatacgtaaatcaataatatcaggaagaggattaccatatatttcgaatgctttagcataagttaattcagcaactcgttcttcagcacgatcaacaaacggagtatagagatccccttttacaacttcaacgtcttcaaatcgatctgcaaaagtattcgtattggttacaacgatctcataggctaaatctttaccaagaaaggcaaattcatctaacatctcatttgttgtgcggaaatgtgcttttggcaaaggcgctggctgagcatcctccccacgacctatagtcctattaatcatggcaccttgtccaagactacgaacaataatctcacggtaaatctcatcttcaggctcaatataatgaacatttcccgtagctaaaacaggcttatctaaacgccgaccgacctctattaggtctctaataatttgttgaatccccacctcatctttaattaaatcacgtactaccaaggggcgataaatagcaggtggcatgacttcaataaaatcataatatttagctagggtcactgctgcatcaattccatttgataacaaggcatcaaaaacttctccatcagaacaggcagtacctagcaagagaccttctctgtgagcatctaaaactgacctaggaattcttgccaccccttcaaaatatttaacatttgaaaggctaactaacttaaatatatttttaagtccaacctgattttggacataaatggttgcatgctttatgcgtgcctttttgtaagagtcttcagctaccaatttagtattgagctccatcaaattagtcacatcacgattttcccgcgcctcttttaagaaaataaagagtaagcgacccgttgcttcagcatcgtagttggccatatgatgatgttccaaagcaacttggaaacgtttggttagaggccccaaaccatgacgcttatattcaggataaagatttcttgcaaattctaaggtatcaatgaccggctgtgtgatcaaaggcagattatgacgttcataattcgcattcataaaaccaacgtcaaaggttgcattatgcgcaactaaaaccgtaccttgacaaaaattctgaaattcctgaaggacttgtaaaataggttttgaacctctgacatgattatccgtaatacctgtcaattcagttgtaaaggcagaaagaggatgacctgggtcaataaactcatcaaattgctcaataatattacccttgaacatttttgatgctgcaatctgaattaggtcattattagctgcagaaagacctgtagtttccacatcaaatacaacataagttgcttcgtgcaaattcatatcaacttcgttgtaggaaataggcactttatcttcaacaatatttgcctctaatccaaaaattgcttttatacctgctttttttgctctgtggtagccatgcggaaaactttgaacattggcatggtcagtaattgcaatagctgggtgtccccacttagctgcagtatcaatgaggctctcgacagttggtaaagcatccatcgttgacatattggtatgagcatgaaattccacacgtttttgatctgctggcattaagtctttacgttcatgatgcacaatctctttgatatcttgaacattcattgtcaaagatttagtaaagttattgttctcaatattccctctgactcgcaaccacgaacctttagaaatcatatcgtacttcttcaattcttcatcatctttagcccacttttgcatagcaaaacttgaggtataatcagtcatcttaaaattaatgatatgacgtccagtgcgggttgtttttcgttcaacactaaaaaccattccttcaaaaacgatacgattttcttctgttgtcacctcaatcatgggtgtaatctctgctttttcaaagccagcttgacgttgtttgatacgctctttgaaatcataattttgagttggggtcacttcttctgatggaggcgctgaatcttctagtgatttttgtgcttccaaggcttgcatagcttcttggttagctttttcaagcaattgctcgcgattagtttcaaatgatgattttaagtcttgcgtcatttgttcatcagaaaccatatcaatagcaagtttaccaaatccaaacaatgaaaactgttgttccaaacgcggcaaatgattctgacgaaaatgattattattgacaaattgaggtgctgaaataatcatctgactgccattgtaatgaacttttaattgtgaaaaagaactcttaaaacttgcactattacacaagggttcacaaaaagcttgttgataataatcctgtagcagatcatcagaaaaatcaatagtttctgctcttatatcaaaagtagcctttatatctgctttttcaaaactattcactaaacgagtttgtaattcacgatacacctcaattggcaataattctggaaatgaaaaatgaaattcccataagcgtgatagagaatgaacctttacctcgataatatcagcagacgaaaaaacacttgaattcttaatttcaagcggcatttcaatctgatccataagtttcttgaacaattctgacatagttttctcctgaatatcttacttccattttatcacatatctgtaaatatttcgagataacaaaaggaggctgttaaaaaaggaatttattagccttcttaacaacactctcttaactgaaactatttatcataagcatctagactgtaggtttcaataatttggtttaatttactagcataagcagtatctgtcgcataaagacctgttagagctgcagtagcatccttataagaagaggtatttgatttccaaacagatgcatacttttgactagatactaactcagcataatcatatagtgaagcagaataatttggataggcgcgaaaaggagcttggatttgagtcatattgcctttcccatcatcttctaaagtaggcatttggacagatttacctttatattctcctttgatgccaaagaggttataattaggagccttagacaaatctgattgtccactggatgattccaaaatagcttgtgctaataagactgacgcatacaaatcataggtcttagaaatttcaatagctgttggagaaatcgtttgaataaaagtcgtcgtttgatccgatgcactagtgactgtcggttcgacattatcatttttataattataaaaccaaaccccacccaaaccaaaaaccaatagtgttgttgttaacctcaataccaatttatctttttttcgacttttcatgatggctcctttctaaaatatcatttcattataacaaaaggcagttgctttttaccaataagaaccatactaaatttcactccatataaaaaagttagcacatcagactaacttttttatcggcttatttttttgttagaatctctaaagtttcaattaagttatcagcgtgaacctcaatcgtatcaccacttgctttaattttcacttcaacgataccttcagaagctttcttcccaacagttactcgaattggaagtccaattaagtcactgtctgagaatttagaaccaacacgttcattacgatcgtctgtcaggacttcataacctttaagcatcaaatcagcttcaattttctcagtaaggtcttgtgactcttgatctttgacattgacagtaatcaaatgtacatcaaatggggctaattcttctgggaaattaatcccccaagcaaagcgataagctccttttggtgtcttattcacaaaaagtcgggcatgttgttcaatgacagctgagagaatacgactaacaccaataccataacaccccataacaataggatttgagcggccattttcatcaaggatgttcgctcccatactatctgaataacgggtacctagtttaaagatatgtccaatttcaataccacgagcaaatttcagagtacctttaccgtctggagaaatctccccttcttttacttcacgaatatcaacgtattcagctgtgaaatcacgttctggattaactccagtaaaatgataaccatcttggttagcaccagacacagcattagcaaggtcttgaactttacgatcagcaataattttaacagagtcaggtaggttaactggcccaagagaaccaaaacctgcaccaaaaatctcttttgcttgctcttcacttgcaggctctaagaaatcagccgctaaataattttttaacttcacatcattgacttgatcgttaccaactagtaaagcaaccacgggctgttcatcagcaataaacaatagtgtcttgatagtttgattttcatcaattgataaaaatccagctacctcatcaattgatttgcagttaggagtttctacttttgttacttcttcaaaggtagcagccttagtagatggtttgtactcattcgttgccatctcaaggttagcagcatagcttgattcagtagagtatgcaatagtgtcctcaccagaaactagccaagccgagagttctaccttaatttcttctaaaacatcctctggaatatcatcaatagaaggaatagttttatcaaggactaaccaacgatttaaatctgtacgattgggagttactgccataaattcttggctatctttacctcccatagcacctccgtcacctataatgcctttaaagtcaagtccagcacgtgtgaagatggcttcatatgctttacggtaatcttcgtaagtgacatcaaggtcttcataatctttgtggaagctgtatccatctttcatgataaattcacgtgttcgaagaagtccattacgaggacgcttctcatcacgatatttagactgaatttgataaaggtttagtggtaattgcttataagattttactgcatcacgaacaagagttgtgaaagtctcttcatgagttggtcctaagataaaatccgattgatcacgattctttaatttataaaggtcttcaccatatgtttcgtagcgcccagattcacgccataaatctgctgtaagaagagctggagctaacatttcaactgcaccaatcttctcaaattcttgacgcataattgttttaaatttttcaatagtacggttagctagaggcaaataagcatagattccagccgaaacttggcggacatatcctgcacgaaccataagagcatggctgataacctgagcatcacttggcatttcgcgaagtgttggaataagcattttactttgtttcattacaataagatacgactaatcaaagttgattctttttcaattgagaattgcaattgaaaaattcgtatttcctttcacgttttattatcttttagaagaaagctcgcatgatatcgttccaggtcacagcaatcattaatactaacataactgctaccccagcgagcgtaatataagtttctgtttcttgtttaagtggtttgcgacgaatggcttctaaaatattcatcactatcttacccccgtcaagggctggtatagggatgagattcataatacctaagttgatagagattaatcccattaagttgagaactgtgacgaaaccatttttagcagcttggctactagcctgatagagagctactggacctcccaatttattaatactaaaatgagcaataagtttctttaattcatttaaaattctaaagaaactttcccatgctagttttaatccacctaaaagtttgtctttaaagcttgtctttaaagctggcataatgccgatgatgtaggatttatcaactttctgtggcttaacgttgatcgttttcaccacctctttgctcttaatcttaagggcaagtttttgttttttttctaaatgcctagttgacttttctactgctgctgtcaactgttcccagttagaaactttgtgcgaccctatttgtaaaatacgatcattattttttaaacctgcactagcggcaggaccattttctgatacacggacctgattggttgataagtcttgaacacctccttgaataaaagcaagtgcaataaagactacaagacctaaaataaaattattcatcggacctgcaaaattggtaattaagcgcccccatacagaagcattctgatactgcatatctaagggagcaatacgaatttcagtaccatcctcctcaatgatagtagcatcgtgatcaacactataggtttttgtctcacttaagaccaatcctgtgatagttagtttatcttctaaatcataagctgttacattgattggtaaagaagtattgtctaattgttttcctgataaattaatacgagttacaatgccttctttatttaaagtaaggctagccggcgtccctgtcttaatttcagtcttatcatcaccccaaccagccatacggacataaccacctagcggtaatatacgaatagtataggttgttccttctttatcaatgtgagaaaagatttttggacccataccaatagcaaattcacgaacaagaattcctgatttctttgcaaaatagaaatgcccaaattcgtgaacaactacaatgacaccaaaaataataataaaggttaaaattcctagcattcaattcctctctaaatacaatatattattttagaataagccaaagaagtgcatgattgggaaaacaaaaatcatactatcaaagcgatccaaaatccccccatgacccggaatcaatttacccgaatctttaacaccaaaatgacgtttaatactactttcaactaaatctccaaattgaccaaaaatgctaaagatagccactaaaactaacatgactaggaagctatgaggcgcatagacggtcttatcaaaaagcataaaaaagaaagctaccacaatggctgaagcaatccctcctagactcccttcaattgttttatttggagacactgagggtagtagtttgcgttgtccaaattgacgaccaatcatataagcaccgatatcagtcgcccagacaataaataaagctaacaacaccttatctattccagccatacgagcactgactagattttgaaagccaatacccacataaaaactagacgcaattggaaaggcagcatcttcaaaactgtaagaattactgttcaaaacagtacctgccaaaatcataaaaataacaataccgtatgctgataaactagcgtcaactggtaaaaaggacaaataactatctaaaggaactgttaaaacaaaggctcctatcatagctaatgcaccttcaaaggaaaatatttctaaacgacgcatacgaagtaattcagaaacaccaatcatagctaaaagtccaactaaaaattggaaaggcaaaccacccattactaaaaaagggataaatatggcaagcgcgacagctccccaaataacacgttctttcattttctctcttctttctatacactaccaaatcgacgatggcgttgattataatccacaatggccttatgtagttcgtcttttttaaaatctggccataaaacgggagtaaagtaaaattcactataagctgattgccaaggtaaaaagttactcaagcgtaactctccactagttcggataatcaaatcagggtctctataaagatagggtaagctatttgtcattaaatgatttgctactaaatcctctgtaatatcgtcaggattcaacttagcttccaaaacatcctgagcaatttccttaatggcattagtgatttctgaacgtccgccataatttagcgcaaaattcaagacgagccccgaattatgttttgtcctcaaacaagcgcgttgcattgcatcgtatgttgccttaggtaatttatgagtatctccgatgacctgtacacgtacattatttttatctaactctggtacatatttatcaaaaaatttaaccggaaggttcataataaacttaacttcatcatctggacgtgaccaattttctgtagaaaaggcatagacagttagtactttaacacctaatcctgaagctgctattgtaacttcttgaagagcatccatccccgccttatgtcccataacgcgtggttttaaacgtttttttgcccaacgtccgttaccatccatgataataccaatatgtgctggtattttctccaaaggcatttctacttgtttttttcttttaaatataaacataatgttccttaatttagcaatcgtttttcttatcagcccttttaaaagagctggaaatatcccatactataacattttaccacatttcaacttatttttgagtattaaaatgccatttgtgacagcaaactaaaaagaccagaacaatcatctggtcctacatatcttattcagtttcgatggctgtttctttattttcgtcttcattgacttcaataatcttaacatcttcaactggttctgttggtgttgctgccttagagacaacagatttgatagctgccaactcaaacgtcaaatagacaccatcaacatctaaaaccattcgttgtgcttcagtattaacttcatcaactactccaaaaagaccaccaattgtgacaatttcatcacctttttgaacagcattcaattgtttttgacgttcttgtgcttgtttcttttgctgacgttgcatgaagaacatcataccaaccataacaacaagcataataataggtaagctcatttgattctcctttccgtgttctacgtaatcattactatagcagatttatgctatatctgcaaggagatactgtctcttagccaataaattcacggatttcttcttttgtcatttttgaatcgcacttcaccttgatagttccgtttttaacaaccatcaaacctggcactgtaggaatgtcatatttatttcgaaattctttatttgcagtccaatgatcaaaatcttcactatctaaatggaataattcaaattcatcttcatcagctacttctacaattttaggaacaaagaggtgacaaaatggacaagaaatacgaccaatgaacagtacaaaatcttgatttgaatcaattttatcttcaatttcggcagccgttatcaaagtcatggttgccaaaagttcttcaaaagaatacatagttaaccaactttctaaatcttatatttaaagaataacctatgatggcaaaacttgcaaggcaagagtaacaacgatcctatcaaaatcattaactcacttctcgcttcaaactatcctcaaaaatgctcactcatatttaaatgactcatcaaaaaaactgagcatagctcagtttttattttacaccttatttttgtacagcattactgacgcttttagcaactacatcggccacatcattttgaaaagcatttggaatgatgtgagttgtgcttaattcttcctccggtattaaactagctatgcctctcgctgccgcaatttgcatttcaacagttatcgtttttgctctagcatctaatgctcctctgaaaatacccggaaatgctaaaacattattaatttgatttggaaaatcactacgaccagttccaactatgtaagctccggcttttaaggcttgatctggataaatttctggaataggattcgccattgcaaatacaataggtttatcagccatcttggaaatccattctgcatgtaatgcttccggagcagaaacacctataaaaacatcggcattctccaaagcatcttctaaggatccagattggaattctctattagtcaattttgcaatcgctttgtgatgaggggctaatgactcccgatctttatcgttaataatgccaaatcgatcaactaccgttacatgttttgctcctgctgatagaagcttccttgttatagataagcccgctgaacctccaccattaacaactactctgatgtcttcaatgtcttttttaactagcttcaaactgttaaacaaagccgctaatactacgattgctgtaccatgttggtcatcatggaaaactggtatatcacattcttcaattaggcgttgttcaatttcgaaacaacgtggtgctgaaatatcctctaaattaatccctccaaaagtcggcgaaatagcttttactatagaaataatttcctctgtatcatttgttttcaacacaattggcacagcatctacatttgcaaaacgtttaaagagtgctgctttaccttccatgactggcattgctgcctcaggaccaatatctcctaatccaagaacagctgaaccatcactcactacggctactgtattttttttagtcgtcaactcatatgcaagctccacatcctctgcaatagctgatgatactgacgccacccctggggtataggcaatactaagatccctcttatcttccaccttaacttttgaaattacttctaattttccaccattttctctagcttggttgatagctaattgacctaaattttcactcattttgataactccttttgataaatattagaataacatgcgtaaaatggctgtcattgtgataacagtaatagctcctcctaaacgcgtagcaacttgagcaaatggcatcaagttcattcggtctgctgtacttaaaatggcaacatctcctgttcctcccataccactttgacaagctgaaataatacctgcttcaacaggattcatattaaggaatcgcgatacaaagaatccaacagaaataactgtaaatacaacactaataacaactatgaaatattgtatgctaagcgttgccacaacatcttttaacgggatataaagcaatcctagacctgccattagaggaaatgtaaaattaccagaaataaatttataaagttgcttagctccattttgtgtttctctaggaataacattaatatatttcaaaatagctgctgcaacaatcattaatacgggaccaggaaatccagttaattgctgcaacaaatgtccaaaaataaagagactacatgctgttaaaacacctccacccattttcttaacgtcaattgggccagaatgatcagcaataatatctgacatgtcctctcctttatttaaccttactaattgcccttgaccagacaagtgtggtttcttttctcccaaacgattcaatagtgcagtacataaaatggcaaagaaattaccaataatagtggctgggatgagttgagcaactagttgttcactagctacaccggtaattgaactatagcctaacgataatggtaaaataccttcaccaataccaccagctaaaacgggtgttacgatataaaacaaagtgtgtcgccactctaagcctaaaataacaccgacaaatgtccctaccatcatcgcacaaaccattcctaataacatggggaaaatcattcttagcaatccctgaatcaacattttccgattcatccctaaaatactaccggacactaaacaagcaatataaaaataaagaaagttagcttgcttcatcaacatatttgttgattctaaaacatttttattaatgaggttgaaaaacaccaaaatagatggtactaataaagataaaatagctgggccaccgaagtttttaaaaccaggaatgctagctccgatagtccctaagaaccaccccattgttaagataactgcaaatcctcctagcatattgactggcaatttttgtaaaaagcctgctagaagaatcaataatgctaaacaaacatatactggtaggggaactgaccctatcttaatatgaaatagtttagcctttaagtcttgcttttgacctctagaatcctcattattcactaccttcacgtctgccatgaaagcacctccttttacttcttatgtacagtttactttgggacttagtgataaggaagtttatttaagtaattgaattatttcaacttatttaattaatttaagctggattctagtttttaggctatgttatactaaactcggagggtgctgatgaaaaaaaaactatctctttgggcatttctatcattgattttagtcactatgaccatttgtatattttctattttttattatgtcactatacatcagtcctatcgtatggtaagggtacaggaagaaaaaatcttaaaaaatactggttatgctttatcgagaaatccacaagttatacaaacactcaaagataatcactatgatcaaagtctccaaaaacaaatgttattccttagcaaaaaatcaaatttagactatattgtccttataaatttaaaagggatccgttttacccaccctgactccactaagattggtaaaccatttcaagggggtgatgaacaagctgtttttaagggaaaagctattatgtctactgcagaaggttctttaggaaaatctttacgatacttaattccagtatatgatcaccaaaaacaggttggggcaattgcagttggcttaaaattaacgacacttggagacttatctcaaagtagcataaaagagtttagtaagcctctcttgattagtattttgattagcttagtcgtcacaagtataatttcttatggcttaaaaaaacaacttcacaacctccatccaagtgatatttttcaacatttagaagagcgcaatgcaacactggaccaaattcaagccgctgtatttgttattgaccagaggcatatcatcaaaagaaataatcctgcagctagtttattattcaaaaaagaggggcaacgagacctattttcaggtaaattattagaatctttaattcctcaactcaagcaggatcatttttcaaaaaaaactgaacaagtattacattttcaaggacaagactatttactatctatctcgccaattacggttaaaacacaaaatagaggctatgttgtcttcttaaggaatgttactgaaacacttttcactttggatcaattagcacacactacagcttatgcttctgcgctacaggcccaaacacatcaatttatgaatcaacttcatgttatttatggacttgcagacattgaatactacgacgagttgaaaatttatttaaaagaattattggagccacaaaatgaatttttagcacgcttatcaatgttagttagagagcctcgactggctagtttcattattggcgaaagagaaaaattcgcagaaaaacacatcaatctatccacagaaattttagtagaaatccctaccaagtcaactgttgaggatgttaataactatctcttgctccacagatatattaatacgaagatactcacgctattaaattcaacgactttagtttctttacgtttaaattatcaaaataacctcattgaaacagattatcaatgggagaatgagaagtggttactcaatgactaccatcagtatttcaacgacgcttattttcaacagttacttgtagattcaagagctacttataagatctctttaaaacaaaataaggttattataagaacaaatattatctactcagaagggccttagtatggacgtattaattatcgaagatgatcctatggtggaatttatccaccgcaattaccttgaaaaactcaattattttcaaaacatctattcaactgctagtcaaacacaagctattgcttatcttaatgacattaaaatccaacttgttcttttagatattcatattaaagaaggcaatggtctagaattattaaagttattacgcaatcaacaccaaaataccgaagtcattgttatttcagcagccaacgaggcgcacactgtcaaagaagcatttcatttaggtattgtagattacctgataaaaccatttacatttgaacgctttgagtctagtattgaaaaattcctaaatcattatcatacatttgaagctgataaaatctatcaagacaacatcgatcactttcaaaaaatagattctggatggctagagggagaggttaaacttgatgagaaagggctctctgaaattacctatcagcatattcttgatgccattcaagagttagagcagcctttcactatccaagagttagcaaaatgcagtcaattttctcatgtctctgttaggaaatatattgcctatatggaagaaaaaggccttctgacaagtcagcaaatttatactaaggtcggtcgtccttacaaagtttataagcttataaaaaaaaacttaggcctgtagacctaagtttttttaatcttcgtagccatttggatgactagaatgccatgcccatgccgatgaaataattttatcaatattatcaaatttaggctcccacccaaggatttgacgagctttctctgaggaagcaataagcgtatctggatctcctggacgacgagctgccttttgagcaggaatttctttcccagtaatacgacgagctgcctctaacatctgaaggttagaaaaacctgtcgaagatccgagattaaacacgtttgattcattcccttggcgaaggtaatcaactgctaatatatgagcatctgccaaatcaaatggatgcacataatctcgaacattagttccatctggagtattgtaatcatctccaaaaatcattattttgtcacgtactccttgagcaacttgaagaatgattggtaacaaatgtgtttctggtttatgatcttccccaattgagccatccggtttatctccagcaacgttgaagtaacgtagagcgacaaacttaataccgtaggcttgatcagcccatttcataattgtttccatcataagcttactttcgccataaggattaataggattttgaggagctgtttctaaaataggaacttgttctggaataccatatgttgcagctgttgatgaaaagacaatatttttgatatcacattcattcattacttctaaaagttttatcattccagcagtgttattatcaaaatattttaaaggattttccattgactcagcaactagtgaaaatgccgcaaaatggataacagcatctacatcaggattttccctaaaaacttgacgcataaacgttttatcggataaatctccttcataaaaaatcgcatctgaatgcaccgcttgacgatgacctgttaccaagttatcaacaacaataactttctcttttccttgtgtgattaactgatcaaccatatgcgagccaatgtagccggcgccacctaaaatcagaactgccatatttttctcctatttcaatactcttttaacatcatttgttacctcattatactgagaataagctttttttgcaaatatctaccgaaattagaatagctctatgcagaaggcatcccacggcttgagagtgttacttgatagtacttcttgaacctctgtatttgaaataatagtttctttaacagcttctggaaattcaaaagattggttttgatcggataagttcgcaactattaaataacgttctttatctgtttgacgaacataagcaaataccttatctgctgtttccaaaagtttaaaatcagcatcaactaaccagtcgtgttctttacgtaaagcaactaatttttgataagtataaaaaatactttccgtatcatttaacgctgcctccacattaatttcctgataattgggattgactgctagccatggggtacctttagtaaaaccagcttgatgttcttgactccactgcattggagtacgagcattatcacgaccgactttacgaatactatctaaaattgttgcttcagataccccattatccatggcttctttagcatagttaagggattcaatatcatctacatctgctaaacactcaaatggataattagtcataccaatttcttcaccttgatagatataaggcgttccacgcatcaaatgtagtaggattgctagagccttggcagattgttttctgttatcactatcatttccccagatcgagagcactcgaggaaggtcatgattattccagaataaagaattccaaccttggccaagctccaattgtgtttgccattttgtaaaaatatctttcaatgctggaacatctaatccgtcactgtaatcccacttaggagcgtcaggtttatgttgaagacctacatgttcaaattgaaagaccatagataattcttcattatcgggatttgagtattgttttgcaatgtctggcgttgctccccaagtttcacccaccgtcaataagtcatgctttccaaaactagctctgttcatttctttaagataatcatgaagttttggtccattaccagtaatgcccttatctggaattttcccaattaaatcaatgacatccatacggaaaccaccaatacccttatcaatccagaaattcatcatatcataaattttatgacgtaaagcttcattctcccagttgagatctggctgacgtttgctaaaaaggtgcaaataatattgacctgatactttatcatattcccaagctgagccactaaaaatagaagtcaaatcgttaggttcatctcgccaaatataaaaatcacgttcaggactattagggttttctcgcgcttctacgaaccaagcatgttcatcagaggtatgattcactaccaaatccatgatgattttaatcccgcgttgatttgcctcttgtaacagttggtccatatcattcatatcaccaaaaatatctgcaatggcttgataatctgaaatatcataaccattgtcatccattggactttgataaacaggtgataaccagatagcagtaatccctaatttttcaaggtagtctagtttgctagtaatccctttaatgtcccccacaccatcaccatctgaatccataaatgaacgtgggtaaatttgataaatcgtagctttatgccaccagtgtttcttcattattcttctcctatcaataattcattcatcttttattttaacgtttttcctcttttagtgcaagcgtttgcgtaaaaacattataaaaaggctggaacccaacctttttatgaatatcgcttataccttaacgaatagcttgttcagtatctgcatcaaagaaatgccccttagcaacattaaacgttaggttaactttttctcctggattatggaagtcacgcgcttcaacacgagaagcaaattctgtttgacctaacttaacataaagcatagtttcgctaccgagtaattcagaaactaaaacttctgcttcaacattggcatttggataagtatcttggacaagaagattgcttgaaatgtcttctggacgaataccaaaaatcaattcttttcctttatagcctcgtgattctaaaagtttttcttgaccttcagggatagcgattcgaagaccatcttcactaataatcataccattttcaactttaactttgaagaagttcatagatgggctaccaatgaatcccgcaacaaatttattggcaggaagattatagagttcttgtggtgaaccaacttgctcaattttaccaattgtaccatcaccatcagggttcttagtagctgacataatgacaatacggtctgccaaagtcatcgcttctgtttggtcgtgggtaacataaatagttgttgaaccaatacgttgatgaatttttgcaatttcagcacgcattgaaacacgtaatttagcatctaagttagataaaggctcatccattaagaacactttggcatcacgcacaatagcacgtcccatagcaacacgttggcgttgtccacctgacaaatccgcaggtttgcgctctaagaattcagtaaggccaatattagctgctgcttcacgaacgcgcttatcaatttcttgttttgagaatttacgcaatttgagcccaaaagccatattatcgtaaacagtcatatgtggataaagagcatagttttggaaaaccatagcaatatcacgatctttaggtgatttgtcattgacaacttcgccatcaatcttgagctcaccttcactaatatcttcaagacctgcgatcatacgaagtgttgttgatttcccacaacctgatggtccaacaaaaacaataaattctttgtctttaatatccaagtcaaagtcttcaacagaataatgcgatgcacttggatattttttgtaaatatgatttaaatttaattctaccattagattgacctcttttattattgtgattttattatagcaaagaaagggttttcatataatggtaaccttgcctaaatttcttgtgcaaactaactaaattttaggtatccatcgaaatcaaataggcataggctaaatcatctaatatttttaaattaagtcccgaagattgggtaaatttatctaatttatattgcaatgaattccgatgaatgaaaagtgccttagccgttttagcaagatttccttgctcttgccacagggcttttattatagccgaagtatcactcgtatcaaggatatgttgtaaacattttgctttaatagaaggcatgggcgattgatttgccaaagcccataaagccatctttggaaatcgacagtaatgttgttcggccttgtgactaagaaaaagcgtaaaaagtttatattcttcttcatataattctttccagtccactgcttgtagatgcgtccaactatttccaaaatagcaccttaaacgcgtgttaaagtcattttcaatcgttggtaaaatatctgttagtaattccgtagcattaaagaaattatcctgatttaaaatcatgacactttgggtttgattaattgtcataattgtttctacgtttattactaaaggcgacaagaaatccttaagttcttctgataaggtaaattgatgctcaataaaaataaattggactgccgaatgagattggggcaaccttccacgaccttcaactagatagcggtaccaaggattctgagaatccactgaactcgcatcttccaggcttggtgtcatttgtaataagtatagttcacgcttagttagcgaagattttggaaagtggaggacatgaccatcttgctcaacgatgatataatcctcactctgtttaacttcctgtttagtaataacttctggaaacagttccttaaaatccatggcatcctccactacagttttgttcattatatcatatttataacctctttttgagcacagaaaaagaggagaatgtctcctcagaaaatttctgttataaaatagtgatccgaatagaatgctgtttcgactgctttggattaagccgtacgatattttgtttatcttctaaaatatcagactcttcaatagaagttgacaaagaactccagggttccaaagccaaaaaaggaccaccattgttacttgtccaaagaataagattctcaaaatcatcaaagtcaagttggattccttttgcatgatttctagattttaagtaaaccgtcttagatcgtagttggtctaaagtaatagcatctttttcaaataaagcatgattaagagataattgtttttgattttctaaaaaaggatgtctagcttgtaaatctaacaagcctgtatccggaaacgactcaggaattgtgcaagtttcaaactgttcaaactctagatagtaatcactaaatacttccttttcaaacaaagggcaattaaagcctgggtgagctccgatagcatatggcatatttttttctgattctaagtttttgacaatatatgtaatggcaatgcttttatttcttaaggtgtaagttatttctaaactaaaacgataaggataatttatcaacatttctttactacttttaattgtaaaacgaacagaagaatccgatatgtaatcatagtcgaatgttttgtgacgtacaaagccatgccttggtatgatacccgtaaaatgtggagcttgagctggtctgtaaatgacgcaatcatttcgaacacttccgcatataggaaataaaataggagcttgcccaccccaataagtggcgtccccttgccaaaggtactcaacgccttgactatctgtaatagaagtcattgttgcacctaacgcttttaatgtcacttgcaactcatgattttgtatcgtaatagccattatttttcctttcataaagaacaataattgctttaccagcttttctctagcaattatctttccttccaagaagttgctgttttttgcaaaattttatttagttcatcaatattttgaaaacctattgtacgtaaccattgacgtgcaccagcttctcctttttcaacatactctttaacacttccagcccaagttgctctaccacaaaggacaccgttaaatttagcaccagcttctttagcaaacacaagagtctcttgaaaaagctgagcaggaactcctgcactcaaaaaaatgtaggggagtagtgtcgcctgatcttgttctctaaaatatgccgcagctgtcgctttattataagcagtctctccttgcgcaaaaccttctacatagtccatattgacaggcacttccaccttcaagacatcaatattaaatcgaggatttgaaaaaactttcatagcttcaataaccttacgtggcttaattttggcatactcaatacctgagctatccgtaatcttttcatcatatgacaaaatttcaaggaaaaaaggaatgtcttctgcaacacattcagaaccaatccgttcaatataagcttctttttcttcgtttacttcatccgaactatcaacatcataataaagtaagaacttaactgcgtctgctccctcttctttaatgcgtttcgcagaccaaatgtctaaacagtctgggagtcgcttggtactactggtatcataacccgttttttcgtacgcaagtaaaagaccggcattgtcatctaaaactttcgtagctggcaacccatattctggatctaacaacattgatgaagcgtaaggggttaattcttcagctaccaaaactttaagtgcttctatttgagaaacagtgggctcctcagattgatattttgccattaatcgcttcaatgctccacgttggtcaaaagccaaggccgaaataataccatttttatcactcaattgttccatatgtttttgtttttgttctgttaatcccatcctatacctctttcacttggatttgactgattaattcttgatagtaggtcagattgatatgccctgttaatgtttcttgtgcattaagcatacccaagacattagctctcttaagcaaatttgtatcatctagttgatgttccaaagcagacgcgattcctgcaaccgttgcatcccctgaaccaactggattaataacttctatttttggaatcgtcacttgatagtagtgattcccatgtttagcaaaagctcccctagcacctaaagaaacaataacccaatcaattcctctaaaaagatcttgctgtaaggtagattttaattcgtctaaactatagctaattggttttccaattaattgtgttaattcttcaaggttaggtttaatgacggtcggcttagcactagattttaaaaccgaacgtaatgcttctcctgaacagtctaaaacaactttcttattaaagtgattcgctagggagattaacctagcataataatctgaggggagtccctttggtaaacttcctgatactgttatgatagttgcagcatcaaagataagttttagatgattcaaaaaggcgtctgcttcatctttagtaatatgtggacctttttctagaatttcagtctgctgaccctcatgtaaaactgcaatacaatgacgtgtttctccaccaatacttaaaaattggtgtctgatttccaatgcatctaagccacttcggatgaaatctccaaaatccccccctaatagaccagttgccactacattatcgccaagttgagaaagaacacgagtcacatttaaccccttacccccaggtgttttggagacgtcggtaactcgatttacagtatccatgttaaagttttctaagcagtacgaaatatcaatagaagggttcaaagttactgttaaaatcatagatatctccttagtcgtgatattcaccacgattccatttatctaagaactctgtgaaaaagtcattctcttcttgatgggcattatgagtctcaacctcggctatcttttcaattaatactttgttttcttttgttggtttatatttagctcttataaacgcctcgatgatatctgtcattaacagcccaccagtaattttcccaccaaatccgataacgttagcatttaattcttctttggcatagatagctgatgtcaaatcacgtaccagagctgagcgaattcctggaactttattaacagcattattaataccaactccagttccacaaatacatacacctaagtcggcttttccactagcgacagcttctcctactttcttaccataaataggatagtgagtacggatattatcataagttccacaatcaataacctcatacccttttgtttttaaataatccacaactgcaattttgtcataagttacaatatgatcacaaccgaccgcaattttcatctgctttacctctcttacgcttagcacattttattcaacatatcgacccgaatttgatgacgacctgcatcgtaagtcccatcaacaaaaccctctactatatgtttagcaactcctggaccaacaatctctgaacctaaagtaatcatcctagcgttattatgagctctagtcatataagctgagcgttcatctgaaacttctgctgcaatcatccccttaaccttagtggctaccataaaaggaccaacaccgtaagcatcaaccattattcctaagttatcttctttttgattcactttagcaacgattgctaaggtattatcaacgaaatctttgctagtatccgttaaatcaataatttccttacctaaacttgtaaggtgttgtctaatcacttccttaagttcaacaccatgcgcatccgccccaataataattgtcatttctttctccttatttcacttttaatacaattgtatgtagttggaagatattgtttgtttttgtttgtaatatcatcatatatcttatttttgtttttgtcaatgttttgttttgtttttgtttgaaatgaacaaaaaaaactccgtgataactatgtcaactaaaattcactactagctagctatcacgaagtttgatacttcttattatttttatttgtaggaacgcttattccgcaagccataatcataaataaaatttaaacaaaacatgccaatttgctgccattttctcccataaagtgccttgcttctctgtattttgactaagaaaactccaattaaaaactttgtaatttaaagtaaaactattttgatgtttttctctatgttcataaaggacaccaaatttatcattattaagttgttgaacagagttgtaagcaaacgaaccatcttgaatgtgatggtgatataaccacttaaaactaccatttcgattaacttgcgctagacgtgcatatccatcttgacgcttcttacctggcccattagcattcactaataaaatatactcttttttgtcatgctcaaagcgaatagctgataattggacgtaagcatcatgaacttccttatatcgtttaacatggttttgccaagtctccccgccgtctttacttgtggctacttctaggttaccagttagattcctcataaataacttaatgtccccatttttcaattgaacgggtacggattctgtattttgttcttttttattatccattgttaaggagtgaattttttcaccattagaaagtatacggttatcattgactgcttttccagtatgccacgtttttccatggtcgtctgaataaattaggcgtgaagattgtgaacctcttagatgagatttccaattcgtagaataggcaggaataataatacgaccagcgtgtggcccccattttaaaactataccttttccaggtcctattcctaaaaatttcatgcctttctgacgaagacttgctgttatatctctaggtgatgaccatgtcctaccatcatcatcgctatatgacatccacacatagcttgattttgctaaacgaaatggtgacgttttatgttttgtaaaatatatatttccaagtagctgttttcccttataaatatcccctagatttgaatggtcacttttagtagtttctgttataacatgataatcagtctttttccctttaaaattatatacaatacctttgtcacggatagtaaaaaccttcgatttctttccattattatataaattaagataagactgtcctccgatttgggtatattctttttcaggtgtgttagcaatactaataacgcctcttccttctggaaacatatcatatattgaaaaaatacgtttcgtcttagagctagtatcttgaactaatgccatatccatattaataggtgagccactatagtcaccactagtaactagcggaactctagggttattacggagattgacaatagtttctctttttccccaagtgacaccatcatcctcactacggcgaataaccattcctatgtttccccaatcacaagcttgctcaattctttcatcagctcccacaagtaaagttcctttttccgtttttaataatgaggggatacggtaaccaaacacattatctttattttttctcccaaaatctcctcccctatatacttctgttttagcagaaagtatagcacctttaggtaatttgagctgatggtttagatgacaataatattgaaaataagattttatatcttcaaaattcaaattatcaacacagcaaacaaggcagtgtgccttagcttttaatttttgccataaattaccactatattttatttccttctctactttctctttgccaatagcaagcatcccctctataacagacgataactttccatccttttgagagaatgttttagtaagatggtgttcctgtatcgcattctttttaaagcccaacgatatctgactagcaatgtccgtattacctatgacattacttgtcgataaatctcccttaggaatgatatccaaagacctcaacttatccctttcaaaacctctatcctctctcgctgtctttctaaattcatcgctattaagtaatgcaaccgaataaccctttgattctatcaggaatctctgttgttctgcaatggaatgactgctttcgggtataatataggtagttctattattaggttgagttgcatttagttctgctaaatttgcctgtttacgattttcttctgtcgctatttccgattttagaggaggtgacaatttttcttgactgtcagaatcacctaagactattaccatatctttatctttttgatcatctactattaaactgtccgatgtatcagaatctaattctaactgcctctcctctattgaattagtaagcttatctaaagtagagtcaaatatgggaacagtagttttttcatcatctattgatataaaagagtttatatcagattttatttcctcactataaattgtactaggatgcaaaaatccacataataagataaaacctagcatcatatatgtactagttatcactcctagacggcgtatcgttatagaaggtttcccaaaggttaatgtcatagaaactccaagtcttaaaatattggttgcatacatcaactctagaaaaatgggagttcagtaatgtttccaaaaaggattgtataccaacttatcactattttcaatatatttttataattttactagttttttattattaagatgagcgaaaattaattatatatgttatttttaaaatctttaatatatcaaaaacctagaaaatataacattctcctaggtttttttattctatttatttttgattagctgcatattctgcattacggcgtttcatttgtttagcataccacataaacaaaccaagataagctgtcgcaaaaataattaatgttataatcgctgataattgacctgttgtcgctttaccaataacgtaaccaaagattttctccatagggccttctagtgtagagtgagtgataagtgaacctgctcgcgccccagctgggaatgcgcctacctttttagctaattcagttgcaaatggggcaatcattgttcctgataaaagaaatagcggtaatagcaatgttccaaaggtaatcatacgaattaaacggccacgtgtaacaaccagtaaagcaggggttacgcccattgcgataataccagcaagcggtagaataccattaccaactttagagagtaaaatagcttctactagcataatcggtgcaagaatgttagcacatgcccaaatctctgcacgtccggcaataaatggccagtccaaaccaatattgaaacgacgaccatgcattttaccattagcaaaattagtaattccttgagaaagtggttctactgcagcaatgaaccaagaaccaatcaaagagaacaactctaaacaagcacctgctgtaaaaccgagagaaaaccagccacctaatgctgcaaatgagaacacggggttgcccataatccctatgacaagtcctaaaatcataccaataaagaacttagagccccagaatccaatggctttatttaatttagccgcgtcaaagtcatatttatctagccctggaaaaactttatcaaaaagcttatccaaaaccataataatggggttcatcatataattcatatgcgttgaagtcatgggagaagttggacctgtccccaataaatcatcaaaggtaggtttcatcaaatcagaattgataatttttagaacaccaacgaagataatagctacagttgcaataatgacagataaaagtgttggtagattattttttttagcataccacataattaaaagacctgtgatagataaatgccaaatatcaaaaatatcaacatctaaggtatccgtttttttcataacaatcataacaatattgacaataagcatgattaataagaagtaaagcgtatatggtgatccccatgtaatagttgctaatggagcccaaccaacgtcaataatgcttagattgattcctgtatttttaacaaaagcttgaagtgattcagaaaaagcaccagttaaaataccaataatagcaccaatacccgtaagagcaatagctaacttaataccaccttcaagtgctttagaaaacttcactccaaatatcatggctaaacctgtcatgacaattagcatcacaactcccgaacccatatggataattggatcaaagaatttattgacaatatttaaaaatacctgcatgttccttctcctttaagactaattccaattttaaatatgttatgatagattgtgttctttgataacttgttctaaagcagtaaagaccggttcgctcataactggtatgcgataaagaataggtcctgcttctacaactggaattggtacattaaaacctaaatcagttttagcaataggagtaaagatatcatatttgttgaccatttcctcagtgatatccttaaccataacagcatcacaatgtacattgtaacctctatctcctaattgtgtctcgatagcatctttaatttgatgacttgagtttacgcctgcaccacaagctgctaatattttgatcatgttaaaacactcctttttctattaaataatgattaattttttctttattgtcgccaagctcatgtagccgatctaggtttccttttgtaataaagaaggtaatcaaattagataaaatatcactttggttactattcctactattaatgatgaagaaaaaatcctgaaccctacactcctcttctggattaatcatatgtttgaaagtaattggctgactatttttgacataaaagattctatctactagacaatactgcgtttcagtgtgtggaatagcaacatattgaataggagtcccatcttttaaatcaatttttaaccccgttggaaactctctctccctttcttttactgcctgtcggtagttaggactaacatagtgttgttttatcaatgcttttgatactaagtcaaataattcttcctgagaatgggcatcaataaataaaatatcttgagtcacagcaaacacctttcttcttagttaagcggttacatttttgttgtaaggcaaacaagccttatcaacttatctacatcaatattatacaaaacaaaataaaacattacaagacattttttattttattttgtttattattgtttattttttcaaaattattattattttagctctatttatggtatgatatatataacgaagaggtaggagaggtcattatgttaaagcgagaaagattacaaaaaataatagaaaaagtcaatataaatggcattgtcactgttaatgaaatcatggaagaacttgatgtatcagacatgactgttaggcgtgacttggatgaattagataaagcaggactgttaatacgcatccatggtggtgcacaaaaagtaaatgcatcaccaactccacaaaattatgaaaaatcaaacactgaaaaatacgatattcaaacaaatgaaaaattagaaattgcccaatttgcaaaacaattcatcaatgatggtgaaacaatctttattgggcctggaacaaccttagagaaattagccacgcaattacttgattttaaaattagggtagtaaccaatagccttcctgttttcaatattctgaatcaaagttcaacacttgaccttatccttgtagggggagagtacagagaaattactggtgcttttgtcggttctgttactattaactctattaaatcacttaatttttcaaaagctttcgttagtagtaatggtgtttttgaaaagtctatcgctacttacgacgagggagaaggtgaaattcagcgcattgctcttaataattcctttgaaaaattccttttagttgatagccaaaaatttggtaaatatgatttttatactttttatcaattagacgatattgattttgtattaacagatcataatattgataatgttgttaaggagcaatacagtagcttcaccaaaattttaactaataacaattacatgtaataaaacaagtgagccactactagaaacctgttatacagcttttagtagtggctctttatttagtgattataactttagtcgttttataaaagtcaaaacaagaaaacttcctcaaacaaaaatatattaactctctttttaagcgtaaaacaatggttgttcaaaagaagaattagatatatcattaaaagcttcgcacgctagaaatcataactaaaaaacaaacaagtacggtgacttgtttgtttttagttgtcagctaagtttactcaactcttttattatttcacttctgttagtgttttaatatcaacaagcactttagagccatcttttttagtaacttgaacttgactaccattaatataattaaagctttcaaaacttacactatatttatttgataattggatgagttgcttttcaaaagattgtctatccataccatatttcttagcgttttgtgccattcctagttcatattcatctagctctgattcatcttcttgtttttctggttcttcttcgtctgaccctttattaacatcataaaaaccatagttgtgagttactttccctgaatcttcaggttcttcatctggagcataatttttggctttattgtctttatttgagcctttgttatgatcactgtcgtgtccccaacctttttcttttggtaattcattaggatgttccatgtagtatttaattgttgagaagagttgttgtaatgtatagccttctggtgctttccataaaccacccttgtcaaaccatgccataggaacattatgataatgatcatgatgaggaacaatcaattgatcatcttcaaatccaactgcatatgccatgtgagcagcaattttatcaagcggtacaattttttctggttttgcttgtttgaatacttctgcagcacttaagtttttgtcactagaatttgatgttgatttattatcagttggtgcaggacttggtttatctgctttattagagtccttttccttataaatttcagcatctttaccccatccttcaactttaggacgtttttctgggtgcatcatgtaatatttagccgtagctaaatagtcttctaaagaatatgtcttatctgaatcagctaaaagatctttttcttcatcaaaccattttaattccacataatggtaatgatctttatgaggaattacaaatgtaccattcttatagtctgtcgcttgtgcaattccaaataataaatcttcaggtttaacaattgcttttggttcaattgcctcatagatttcttgagctgttttacctgtttttggtttgtcttgatttgcttcagattttcctgaaagaaattcttgagctgcttttaattccgactctgataaatctttctttggtacccaatgctcatgtgtcatataatgtaaccatcagatgttgtgtatttaccagcttttttgcctcttcaatttcttgagcactgtagacaatctggctatttggtttgcctttacgttggtctttcggtgttactgcatggtgttcttcctctgtgtgaggttccttattaggttcatgagaaatatgctttggtttctctgtagaatcttttttccctaatgcatcaatatgatgtcctctatgctctgccaccatccttgttgcttctaactctaatggagacatatccttatagtgaataaagtggaaatgattaccgtgcggaatagaaacaccgattgctgtgaaagcattaacttgtgctgggtcataaaccaaaccatcactttctacgtgacgagcatataacggttgagcatataaacgtttcaacattttgtctaaagcagaatctttgttgattggtttggttgtaggtgcatggtgttttggtgccgtagcatgattaccagctggttttgaccagtgatttgcgtgagtgactcttggaatagaaataggggcattagcatgtcttcctgttgatacattaccgcttggtgcacttgcatgaatgtatgaacttgaatttgatggttttgagctattacctgatcggccagtcttgcggttccaatatgcctgtgcggctgataactctgatggagataaatcagctttcgggatataatggaaatgatcgccatgtggtactaaaaaggcatctcccatgtcatcaatgacatctgttggactaaaaacataaccatcatctgtagtatagcgaccgctagctttcgcttcacgtacgctggctgataaagcttgagtttttgcactactatgctttcctgattctcccttagaaccacccttagaccattcttcgcgttgcttttggatttgttcctttgtacgaacatttgttcgtttgctaccttctttaagatagaggtaatacttaccgttaactttgataatataaccatctttgacttcattaatgacatcagctttattaaagacatagctagggtctttcataatcaattcttcactaatgatggcatcatatggcactttcccattgtaataatggtaatggtctccatgagaagtcacataaccgtcgtcagtaattttaacaacgatttgttctgcagatatgccttcttctttactgatttggtcgggcgttttatttacagctgttgcttgtgctttgctatcagatttatctgttttcacataagaaacactattgtctgatttttgggcattatagctacctaattggtaagcacctacaccagtaccaaatagagctactgataaagcactaataataactgtttttttacgattcatcctgcgtcctttctttatataactacctattgatttaacgatttgacaagtaccttaagattagtttccaaattttctaagtaatctttattgtttttgggaactgcttctaaaggacttaaacttgcaattttaactcgagtagctgaagctactgcttgagctaatttaggtgagactccttcttcaacaaaaatagtcttaaccttatatgttttcacaaactcctgaatttcggctaattttttagcactaggttcttgctcggttgagacacctgcaatacctaactgagtcaatccgtatcgcttagctaagtatgagaatgctgtatgtgaagtcacaaagtatttagactttgcagctttaaattttggcttatacttctctgcaatagccattgccttgtcactaaattgatcagcatttttttgataaaccttagcgtttttaggatcctttttagctaattgtgtagcgatgagttgtgcttcctcagatacttttacagggtcattccaagtgtgagggtcatacaaggttgactcatctactcctttttctgcctctacatcttctaagccatgaactttatccaaagtcataccttttgaagcttcaattacagatactttagagtgatgcaaactaggttccaaacgtctcgcccaagcttctagtgtgtgcgaatgataaagaaatagatcagcatcataaatggcagcaacatcacttgatgagggttcaaaaccatgaatacctgactgtgatcgaatcattttaatatcattcaaatcaccagaaactgcttttgtaatggaatatactggataaaagctagtcactactgacaagccatttttttgctggctttgtttagtacaagcacataagcaaattagggtaactactccgagaacaaaaataaggcttttccgtatccttttcattaaacctcctttaaaataaaaaatacttaaccagttaatattttagagtattcttattttagtgtcaacgaaaaaccataaatctaatatttttctatttttaatattgttaagtgcacttaatttcatatcaacaacctttattcatgcctttccaagctacagtaaatcttttcataaacatgaatgggttaaggagtataattagaaccacaataaaaagagccaagcattctgcccaactctttggttttttatttatttttagtatctaaaacgatagttactggtccatcattaatcagactgacttgcatatcagctccaaattgacctgtttctaccgaaacatgatttgctaattcttgattaaagatatcataaaactgattcgctttaacaggatcagctgccccagtaaaagctggacgatttccttttttggtatctgcaaagagtgtaaattgtgagatagataagacgcttcctttaatgtcttgaattgaaaggttcattttcccctcatcatcagaaaaaatacgcatgctagtaattttacgaactgcataagcaatatcttctgttgtatcttctggagcaatcccaactagaagtactaaacccttctcaatagatccgactacatcatcttcaatagaaacacttgcttgattaacacgttgaataatgattttcattttgctctcctaaccattcgtacgtttaacagaataaacatctgggataattttgattttatcaaccacagttgtcaattgtgctaaatttgaaattccaaagctaacatgaatattagcaaatttcatatcttttgttggttgtgcatttactgtcgatactagctttgttgcatttgataaggtttgaagaacatcattaaggaggccactacgattcaaaccataaatatcgatttcagccatgtactcttttttagatccatcatcatcccactcaacatcaatcaaacgttgttcgtagttctcctgactctttaaattttgacaatctgaacgatggatagccacgcctctacctttagttatatagccttcaatgagatctccaggaacgggattacaacattttgcaatacgcattaataaacctgaagctccttgaatgataacaccattttcactcttaactttgagaacatcacgcttatcggttttgatttcaccaccgttaataagttcgtctgcttccgctttagccttagcacgttcctcctcacggcgttctttttccgtcagtttattaaaaatactaatcggactcaaatcaccaaaacctacggctgcatacaaagcttcctcacttttaacactgacacgtggaaggatttcttcaatatgtttcttatctaaatatttgttaggcacataaccttgttcttggaaataatcaaccagtaattctctacctttattaatagaagtttctttatcttggtttttgaagaactgacgaattttattgcgagctttattggtcttaacaatcttaatccagtcacgacttggtccaaatgaattagggtttgtgataatctcaacaacatctcctgtttttaacttagcagtcaatggaaccatacgtccatttactttagcgccagtagctttttctccaacttgcgtgtgaatagcataagcaaaatcaattggtccagattcccttggcaattcctgaacagcaccatttggggtaaaaacatagatgcgttctgtaaagatatcttccttaacagagtcaacaaaatccttggcgtcttttgattcatcttgaagctcaactaattcttgaatccatcccataccaaccgattgctctgcttgattaaccttactggtgattccttttttataggcccaatgggctgcaacaccaaactcggcaacttgatgcatttctttagttcgaatctgaatttcaattggccctttaggtccataaaccgtcgtgtgaatagattgataaccattggcctttggtgccgcaatataatctttaaaccttcctggcataggacgccataactcatggatataccccaccatggcataaacatcactagcagtttccatgatacagcgtatcgcaattaaatcataaatctgatcaaagcgtttctttttatcacgcatttttctgtaaatagaataaatgtgttttggtctaccataaatatcaccatataaaccctgttcctcagtataggatctgattttatcgacaattatatcaaccaactcttcgcgttcacgacgtttttcactcatcatatgagaaatcttataaaattccgtctcattcaagtaacgaaaagataaatcttctaattcccacttgatacgactaatccccaaacgatgcgctaaaggagcgtatatttccatagtctcacgtgaaatacgctcttgtttatcttttctgaggtgtttaagggttctcatattatgtaagcggtcagcgagcttaaccaaaataacacggatatccttagacatagccattaacattttacggtgattttctgctaactgttcttcatgagatttgtactccactttacccaattttgttacgccgtcaataatatcgcgaacatccttgccaaaatcagtttcaatctcatcaagggtaatttccgtatcttctacaacatcatgtaaaaaaccacaagctaccgtaacggcatcaaggtgtaaatctgcaagaatacctgctacttgaattggatgaataatgtagggctcgcccgactttcttgcttgataataatgagctgcggttgcgtaatttaaggcaaattttacaaaagcaacatccgtctcactcatgtactgggatgtgattgcaacaacctcttctcctgttaaattaatttctttgaccatagttatcctctttaatcatagtgatagattgtacctattttatcactttttaacctaaaaataaaagaagttagaggctcaaaaagaattaaataccaagtaaatgtgtctaactaagttatcctttataaataaacgattgtttttggtgtaatcactaaaaataattcgtaaatgagattgattaaacgttttcaataagctataatagtttttagattaggataatatacatgtaatgttttaatggaggagatttatgtcaaaacattatttttcaaaaagcgtattcgctttaactgtcttaacagctacagcaacaagtggtttagctgttcaagcagaagacattgttacaacaccaagttcaacctctacaaaggttgaatcaactacccccactagcacaattgcagaggaaaagtcaaacgttacttctactccaactgcaataactgatgcttcaacagccacaagcacaaataccactaccaataaccaaaatccacagcctgttgccacagaagccacaactagtgatctcaaacctattgaaggtgaaaaagttgaccttcgcatcatgtcaaccacagacctacacaccaatttagttaactatgattattatcaagataaagaatctcaaaaaatagggttagcaaaaactgctgtccttattgaagaagcaaaaaaagaaaatcctaataccgtcttagttgataacggagatgtcattcaagggacacctttaggaacttataaagcaatcgttaaacctgtcgcagaaaatgaagaacatcctatgtaccaagccatgaatgctcttggttatgatgcatcaacactaggtaatcatgagtttaattacggtttagattacctcaaaaaaatcattgctacagccaaccttccaatcctcaacgcaaatgttttggatttcaaaacacatcaaccagtttttaaaacttatgacatcattactaaaaccttcaaagattcaacaggaagagctgttgcactaaatattgggattacaggaattgtacctcctcaaatcttaaactgggacaaggctaacctagagggaaaggttattgtcaaagattcagttaaagcaatcgaagaaatcgttcctactatgcgtgctaaaggagcagatgtcattctcgttttatcacactctggcattggagatgatcgatatgaagaaggtgaagaaaacgttggctatcaaattgccagcatcaagggagtggatgccgttgttacgggacactcacacgctgaatttccatcaggtaacggtactggcttctatgaaaaatacactggagttgatggtatcaatggaaaaataaatggaacacctgttacaatggcaggcaagtacggggatcatcttggtattattgatttaggacttagttatactaatggaaaatggcaagtctccgaaagtagtgctaaaatccgtaaaattgatatgaactcaacaactgctgacgagcgtatcattgcattggctaaggaagcacacgatggcactatcaactatgttcgccaacaagtaggtacaacaactgcgccaattacaagttactttgcactagttaaagatgacccttcagttcaaattgttaacaacgctcaacgttggtacgttgcaaatgaattgaaaggaacacctgaggcaaatttaccacttctatctgctgcagcaccatttaaagctggaacacgcggcgatgctaccgcatatactgatattccagctggacctgttgcaattaaaaacgtagctgatctttacctttatgataatgttactgcacttttaaaagtgaccggagcagacttacgtgaatggttagaaatgtccgctggtcaatttaaccaaattgaccctaacaataaagcaccacaaaatattatcaataccgaatatcgtacctataattttgacgttattgacggcttgacttataaatttgatattacacaacctaataaatacaataaagatggaaaagttgttaatagtcaagctagtcgagtacgcgatttaatgtacaatggtaagcctgttgcagacaaacaagagtttatgattgtgaccaataactaccgtgctagtggtaccttccctggggctaaaaatgccacaatgaaccgtttgctgaacttagaaaatcgccaaactattatcaactatattatttcagagaaaaccatcaatcctacagctgataataactggggcttcacagagtctattaaagaccttgatttacgattccaaacagccgataaagctaaaaatcttgttactaatagcaaggatattcagtatatcgctagttctaccaaagatgaaggatttggtgattatcgatttgtctatactgaacaagaaaaagtagaccttactgagccatcacatcaagaaaagttaagccaaatagaaaaacaaaaaattcaccacatggttgcaactgcttatacaaaagcaaaagcttctccaaatattacaggcactgtctatacacaacagaaagaaaaaacattacctaaaactggacaagaaaaacaatcttatctggctttctttggtgtcgcaatacttggactcgtgggaagtttacttaaaaagaaacaaatatagtcatcactaaaaactgaggccaatcaacctcagtttttagtctcaacaatagattttctctctaaatagtcagatattgagataccactctagcttgtttatctgacatgattttgctaaactgataacaagaaatttagatttaaggagtactaaatgcctaaattaaccctagtctatatcagtcttagcggcaatactcaaagctttgtcaaacgtcttagtgaacaactgtcaacttggcataactgtcaggtttcgactattaatatcaaggaacaaaatcatcaaacctttcctgttgaccaacctttcgtagcactattacccacttaccttgagggaggaaatggcattgacaatggcgatcaagaaattcttaccattccacttggtgattttatagctgcacacaataatgtcaaaaattgtatcggaattgttggctctggaaatagaaattttaacaatcagtactgtttaactgcaaaacaatactctgaacggtttggatttcctatgttaggagactttgaattgcgaggaacttctagcgacgttgaacgtatcgcaaatattatcgttgaaacattatcgaactttaaagcctaaaggaaatagtatggaaacaacattaaactacattaaaaccctgacatcaatcccttcaccaacagggtttacccaaacaatcatgacctatatcatcaaagaattggaagcgtttggctactcaccaattcgcacaaacaagggaggcgtcatggtttctctaaaaggaaaaaatgatactaaacatcgcatgataactgctcaccttgatacacttggtgctatggttagggccatcaaaccagatggtcggttaaaaattgaccttattggtggatatacatacaatgccattgaaggagaaaactgtactatacacctctcaaaaaatggtaaagaaatttctggaactgctcttattcatcaaactagtgtccatgtttacaaagacgctggaactgctgaacgtaatcaaacaaatatggaaattcgtttagatgagaaagtaacaactgctgacgaaacacgtgctttaggcatccaggtcggtgatttcatttcatttgatccgcgtacaatcataacagacagcggctttattaaatcacgttacctagatgacaaggtatccgctggtatcctaatggaacttctttctgtttacaagaaagaagacattcaacttccttatactactcatttctactttagtgcctttgaagagctaggacatggagcaaattcaagcatcccaaatgaaactgtagaatatctagcagttgatatgggagctatgggagacgatcaagaaactgacgaatatactgtctctatctgtgttaaagatgcttctggtccttatcattatgaattacgtcaacatcttgtttctctagctgaaaacaataatattccttataaacttgatatttatccttattatggtagtgacgcctccgctgccatgcgtgctggtgcggaagttaaacacgcgctacttggtgcaggtattgaatctagtcattcttatgaacgtacccatatcgattctattcaagcaactgaactcttagtggatgcctatctcaaaagcaatatggtggactaatggtagccacgctcattattatcaggggaaattcagctagcggaaagtctacaatagctaagcaacttcaagccgaattaggggaaaatacccttctcttatctcaggattaccttcgtagagagatgttaggaactaaggatggtgaaaatactactaccattccccttttgatcaatttactaaattatggttaccataactgttcctacatcatccttgaaggcatacttcgttctgattggtatacgcctgtttggaaacatattttaaaacataaccccaacaatacttatgcttattactatgatttaagctttcaagaaactgttaaaagacattcaactcgacttaaatctttagaatttggagaagattctcttgcaagatggtggcttgagaaagatttcttaaaagagatacctgaaaaaatattaacaaaagctatgagtttagaggatgtcaaaaaacttataatgaccgacgttttaccttaacattattgtacgcactataaacaataatgacttcttatcattggagtatattgcccatggatacagtgattgacctcttatttattatcgttcccattatagccggatttctggcatgtattagtctttatcgttattggaaaaaagatttcgaaagcgacgaagacgacgattaaactcctcggaatcaatgattccaaggagtttttctatattctcatttaatcagcatttctacgaatacgattataggttttaaggatttggcccttatgcttagtgacatagcgataatcttctttaagagtagcaatatcctttaaagctttcatgccattactcgtttgggcatctttacgaataggtcggttactcgttgactgcccaaaggcattttgaacatctaaagaaagcataaaattaataaataactttgcttctttcatagaaggagcattctttataattgcaaccgaagatgggacaaaaactgtcccttctgtcggatatacaatagaaacattggcaccacttttttgcaaattgacactagggtcttcgtaagtcagccccacaatcatttttccttctgcaactgattgataaacttctgaagagctagaagatttgatagcattaatattatgttgtagctttttaacatagttccacgcttttggattggtgtaaccacccttggccaagagtatattagtgagttgtgagaaagcactagaggaagtattcggatctgcaaaggcaattttaccttttaaggaaggctgtaataaatcttcataactcttgatggtaagtcccttagctaattcgttatttacaatcaagacactcccatttatagtataaggtgtcgccgtatcacttggatggatatagtctggaataacagtatgaacattctttgatacgtaagactcaaacaatgccttatgactttcaaattgcgtataatttcctccaaagaaaatatccgccttcaactgcttaccctccttacttaatctatctattagttgccctgtcccaccttgaataagcttaacttttataccgtatttttcctcaaaagctggaatcgttcctgttaaaatggcttgactatttggacttagaataactaattcttttggtggaagtagtttagaaggctggctaatactgtatgtaaaaacacttataaaaataatggaaacaaccagtagtatataaataagccttttcgactgtttttctttcatctttcacctacctaatccatttgtttaaaaatatgttcttccttaaacgcttttactgtctgacccaagtactttttaaaaaccctatcaaaataacgataatcataaataccaacagcttctgcaatttggtaaaccattaggtctggttctctaaacatcaactgaatggcttgattaatacgatattgatttatataatcactcaaagttatatgaaggtgctttttagtgactgtgtaaagataactttcactgtaacctaaatcgtgagctaactggctaatcacaattttcccatgaaaatggctatgaatccatgctagcatatctttaataacttcaggaacttggtcattagcttgtggtagaggtaaatacaattctgtatgctcttgtaggtgcttctccttatgttcctcaattctagccataattgtttttaaacaatcaatcaaagcttgcttttctagtggttttgttaaaaattcaagaacgccatagtgaatagctgattgcgcatttggaaaatcagcatagccagataaaataattttggcataagattgtcctttggttgcctcaaacatatcgaatgctgtcataattggcatattaatatcacttaaaacaatgtctggctgctcttcctgaattaattgagctccttctttaccatcttttgcttcaccaaccactaaaatattcaatgattgataatcaatagcatagcgtaaccacttacgaataaggtgctcatcctcaacgataagtaatctatacataactcactcctttactatatagctaactcgaaaagcatcatctgtcttcgtaaactctaacaatactgttgaaaattgatattgtaatcgtctataagaattaataagcccatgatgcgagtgagttgatcttaacattgtacgtatggcttgttgcctagccaaactaatacctgatccattatttgaaacagtaaaccaaattccatcactatcttgccaaatatctatgtttattgctacatcatgacgttcttttaagccatatttaatagcattctcaattagcggtaacaagaaaagttttggtacacgcatgtgttcaagttcaggagatactgaaatagtgtaagttaattcttcaaatctcacttgattaatcaaaaggtaggattcaatgattgctaaatcatccttaagcacagctgcttctgtgctaccactaaggctatagcgcaataattttgttagttgtataacgattctttctgttaattgtgaatcatagtgactggttattaaaattgtctcaagggtattataaaggaagtgaggattaaactgagcttctaacatcctcttttcaaacaacaacttttgtgtttccaaatcaagagttttctcatgtaaatcttttaaccgtgaaaccatctgattgatttgcacagatagatattgaaattcatcttgactatcaagctcaatactagatttttcttggcgggaaatggcatccatatctagcaccatttgatttatggcgctagaattttttactgcgatgcgatcggctagaactctagatttttgtcgtaaaatcacaaaaataataactgatgatactagagaaaaaaggacgaccagagttactggtatcaggggacgatacatgtaaagtaggatattgtcttgcagagctactttcctaacaacaaaagctcgatgatcgtgaaaactaaaatatctagttaagaattgactatctaccttatctaaactagaggagataaaatcacgattagtaaaagtaaagctattatttagctgatcggcaataatcaagtctgagttaatagccttcgttggaagtaaaaagtctttcccattcatcaataaaaaggcataacctgaaacttttttattaactataattggcttaatgagtgcaaggtaatgccctccctcactatccacaataatttttagtagcctttgatttattttagccttatctaaaacttcactaatgtaaatagacttactaaaaaaattacctaaatgtgaattactagcaaacaaaagttcttgattaggtgagaatactaaaagttctgtttgactttgtaaatgattccttaaatgataatattgcttactcaaatcagcacttcctaagtgtcctgagacaaatggtttcaaactatttttacctaagtcatctaataaggtatcatgtttttgaatcaattgcttataactataggaaactgaattaacatctttataaagacctatctgttgaggcgctaaagaaaaaaggacgaaaagtgcaatcaataacaaggataaaattaaagactggcgggaaaaatgtttagagatatcatcttgtagtcgtttcttaaagcgttcttccattctatatcctctcatttccatctccttttattatagcaaatagctatccaataaagatagtcaactcctttcatacaataactttcaaaagaaaaaaagataagctaaacaagtatcgtcttgttccacttacctttaatgctaggagattattagcaaatacctaagagaccaagtacaatacctaacaccataataccaaacatgatccagttgatattgacttttttacgtagaagccagaaggctaatatcgttaccaacagtggcactacgccaacaaataattggtcaaggtaactttgtatggaagctgcttccttagctcctttagctgctaccgttaagattgtcttgaatttaacatttgaagcagtcattgagcctaccatcattaaaccaagcatacttgaagtcttagtaacaattttaataccacctgattcatacaattttttgataaaccctgcacctacagagtaacctccatagagactataataatgaatcagaaaagctggaatgttatacaagagtagaaagacaacagctcccatggctgagcctgtacttgctaaggagataccgatacctgccgcaataacccttagaattccccaaaagaatgaatcaccaacaccagatataggtcccatcaaagaagccttaactgcggtgatagcactagcgtcaaaatcaggatcttcactgtttttcttttccatagatgcaacaagacccataataaaattattaatgtgcatggtggcattaaaccatgttgtatgacggaccagtgcctctgctttatccttatcagtcttataaaaacgattgatgactggtagtaaagtataaataactcctactgcgtggtattgtgttgccccagtacgactggcattcatcgtccatgagcgccagaagactgagcgaagcattttacggtcttctttagtcaaattatcctgtgatttcatgcgaagaagtcctcctcttctgattctttagagtcaaaggttgtctgtttactgatcgcacctctagtaattgcgtctaattctatatcacgttgtgaactaatgacgcaaataactgctcctagggcagcaactgcaaccgctggtaattttaaataagctgttaaaacaaaaccaagcaagtaaaaaacagctaatttatttgtccataataatttcatcagcatggcaaaaccaacagctggaaggaggcctcccgccgcactcaaaccattcatcaggttttgaggaatatgatggacaaaactattaacaggcccactacctactaaaataccaatgaaagaaatagaagcgataatgagatagtaaataatccatgtaccatagtgaagcatcacaagtttaccttgatggtttgcggctgcagctttatccaccatcggtgcaaagatattcatgaagacgtttttcaaaaacataacaacaaatgctgccaacattccaatcggaacagctagagtcattgctgctttttgatcaatgtttgaaataatggtaaaagttgttgccatcgctgttgctgttactggctctgcggcaataacacccccaatattaacgtttcccaaaaatagcgcttctagggaggctcccattaggataccaaccttaatatcacctagtagcattcctgttacaagaccaactacaagtggtctctccatcatactttgacctgttaagtaatttcccccaaaacaaatcaatacagctaaagctgccatcgtcgctggcattatcatatgtcatacctcactttatttgactaactgactcaagttaaccttagtatttgaaggcaatacttggttaaagacgtctaaatctggtaagctggctaattcttttgcggcttccaactcttctgtatttaataagagacttgatgttagtttgacttttgtagctggatcagacttatcaaagcgtcctacattagcgacgtttactgcttctaaatcggttatatttttagcaattgtacaggcatctttaacagaattgacaatcacaaaaatgcgcttgtcagttgcacgtggatctttaaatagagctattgattcttcaactgaacggattaataatttcatgccattaggcacagccattttaagagtcatctgtgtgatttcattttttgcagcttcatcattagccaccactaaaagtggtgcatttaattctttagtccatacaactgccacttgcccgtgaatcaaacggtcgtcaacacgaatttgagtaatcatttttttcctcctaattattaatcgaaaaagtcatcttctgaacccgctttaaagctaagatctaccagctgcacttgagattcattgataacggttacaatttcttctttagttaattcctcttcaggtttcaaaaatagtaatgacaacaaggtcgctaaattgctgttcgttattaaaaaaatattatttttcccactattcattacagcagtcgccattttctgattaacgctgccacctaacaaatctgtaaaaataagcccctgttcatctggtgcaatctcatcaataaattctacaatagacttagtatagtcactatcatcaatgtaagcatctattgtctgaatctcttgtcccttgcctgtcagaatatcaatagaactctgcaacccactcgcaagttttccgtgactgccgattaggaatttccgcttcatctttctcctcctatttattacattaccctaaattagttctgaaagttttatcaatactttgaataagataacctttactatcattctaacaaatgaaagcggtttaaaaatggactattctactctatatgtggactattctacataattaatatttaaaaacagaacaataaaaaggtcatgtatcctaatagtttacacaacctttacatcactataactttaaactttctcttatatgcatcactatttcgaaagagataatggaataattttttgatagggtatcttattaacaacctttattatgagtagagcacaagcatgtgttaatgccaaggtcaccacaaaaatcacttttccttgatggtgtgcaactaaggaagttgattttaaacagtaagacactatgccaataaaaagagggggaaggaagaaataatagacactcaactgttttaaaggacttaaacgatattccttaaacagtgatgtacgtatactccagttaaataagaatactgcacataaaggagctaataagaagaaatttttatccaacccttgattaaaataaataagaacattctctaaagctagaagtaaaaggaagagaatatacttaagaccacgcgatttggtaaataggtcagtattaaaataatcatagagtaaatatcctgctagaagataaactggagtgtaaaataatccgtttcgtgttgtctgaaaaattgacatataagtggacatcaggggataaaattttgttgactgtataaagacagaataggtctctactgctccaatacaatagagtacaacaactgtgataaatgtccccctagttcctacatacttcaataatccttgaataatgacccaacctagaataacagcagggatgtaccaaagggtatgtgacatacctaaatacaaaaatgccacaataaaccccggcaacaaatagatcttcgctatatttagagattcaaaaaagaaataaccataaggcaaataaatgatagtccacatgctatactttttaatcagtttacgaaagtaggagtgattacacaaaccttgctgtatacgacctctcaaaaagaaagcagtacaaatcaaaaaataaggaacagccatccgacctaggaaacttttaaaggtaaaatgaatgacatcctgactaaataacctcccactatgaactaaaatgaccagtatggaaaaaaggtattgtagcaaactaatcattgatgtattatgctgcttattatccacgcactgacttctcttcatccttaacattactttctataagttatcattactatgataccaatctcttcagaagaatatctcaattatcccaaaaagtcattgaaacgccttaaatggtatctgataattattgttaataccttatcaaccatattaggaaataaaaaagctgatttcgcaaaagaaaatcagcttagaataatttcttgttcagataaccagtgggaactataaacttcttcgtcgcattaaacgataggtataggctatcaataacactgcaattaacatacgtagactaatcagacagatttcattagcagaaaaactatcaaagaaaaagccatgactaccattacgtgataattttaaaagtaaagctgaagtgtctgtcgttgatactgagaaaatagttaataacttgtttatcacacctttattaaacatagccattaaaaagctaggagcaaaaaaggcaagcgttgaaacagcaaaagatgttaatggcgaatttgtgatacttgatataaagaaattaagactggctataaaaaggagtccaacaaattgtaagacaataatatgaacaaaagcagttgatattgtcataggtacaggaaatcccataatattagccaaaggtgatgtccagtataaattcagttgaacgcttgtctcccaaccactaaaaccaaaataatctgcaaataccgtcagaatgagggcatatgctaggataaatgtggaaataccgatggtcattgtactagctaacttagcccaggtcaactgaccacgtccataccgagtcgtcagtagtataggattaatcttcttagccctatctcctgaaaaaagaggagctgataagaatagagtaaataagacaattaaaatataagtactattacttacttcgaaaagttgattccaaggagcaaagttacctagctttagttgttttagtggtagcgcagaacccaactgtttttgatctttaatatttattttattaaaatcaattgttttatcatctttcaattggttatagtaaattaaaaaatcacgatcaaaagtgtctgccacataataactaaaaacatcaaatataggggggcgtcctgctggcggattaacatagtttttaataatatttgttactcgttcttcagataaatcccctgaatatttttcagctattctacgattaatggcaaccgcttctcgaccatgtattttatctgcagaatagccactaatttgcccaacaaaaaaatgctggtaaaatagaccaaaaatagcaagaaggaagataataaaagccccaaatgctgccttacgttgtagaagtttttttaattcaaaaggaaaaattgatatcatcttacttactcccctctaaaatgatagatgtagaaatcttctagagtcggaacaaccaactgtgccgaatcactcggacaaatatcactcactacacgaaatacccgactatctgaaaagactttttcattaacaatagcaatattgggtatctgagataaacctggttcagtcgttatttcccacacttttccctcaatagttttcaacagctgtgcggtgttgccatgttcgataaatttaccattttttaatactataatttctttggcaacagcttccacatccgacacaatatgcgttgataaaatgataattttattggtggataactgactcaaaatatggcgaaatttaacccgttccttgggatcaagtccaacagttggttcatccagaatgagtatttcaggatcattgataagtgcttgagcaatgcctaaacgttgcttcataccaccggagtatgatgaaatcttctttttacctacatcgcctaaaccaacaagctctagtaatctaggaatttcttgtttagctttctttttatcaacaccttttaaggtagcgatataatttaagaaagcaatgccagtaaattgatcataatagcgaaaatgttgcggtaaaaaaccaatgtgacgataaaattcttccgactgctcctgtccattccaataaatattcccactatctgctaatgtaaagtggctcatcaaatttaataaggttgttttgccagtaccatttgctcctaagagtccatacaaaccaggagtaaactggtaggaaatctggttaagtactatttttttcccgtagcttttagtgatattatctagctgtaataacatagtattgtctcctttcaataattaagacagttgaaaaatcaattactaaaatatagcgactgagctaaaggttaaaaatgagctttctcacttactctctaaatgattgtaaagtaatatagctaaaagattatttctaagccctgacggaaagtatgttgttcactatttgtactaatagatgcattgggataacggtcaataactttcatgacattataaaggcctaaccctctatcttctcccttgctacttgctccataaccaaacaaacgtgaagcatctattctttcctcgactatcgaattttctatgataaaaatttgcttatggtttaatgtaaaataagacatggctatcttaggttcatctgtctctaaagaaacttcaatatggtggctataatctatcatattagccaattagagttttctttgaacaaccaacctctcctgtaaagaagttttgaagtaacggtctaaaatagaactcatctttttctatccttttgatatttatccactatagatactatatctctcactttattgcgtgaaaccagacaagtcgttccattttggaagtaaactaatctatctatcctatccactttaaaaatatttaagggatttactaaaaaagagcgatgacattgaaagagcctaggttcttgttttaaaatatcccccaaagtggctgtgaattccattctatctttttcagtataaaggacaactctatgtgatcttgaggatgtttctatataaagaagatcgttaaaaggtaattgtacctggctgtaacgcgacttaaagtagaatgaattttccactaagggcttattgcaaatgccatctacgtacaacaatacttcctcaatcctttggctaaactcttcctgtgaaagtcctttatcgatatagtctaaagctgatacctgataacgaaaggttaaaggcattaattctgaatgagttgtaacaaaaacaatctgagcatatggatcaacttgtctaatttgttttgctacctctaagcccatctgctcatcattttttatttcaatatctaagaaaaataaattatgtaaacctatttcataaattgattccaataattgaactggtttagcaaacgtttctactgttttgaaatgcagattgtactgtactctaatctctttaatgattttttcaaaatgggcttgttgaacaaaatcatcctcaagtataaaaatattcaccttatatcctctatcttattacttgaatattaatagtcacaatagagccactacgatattcttctcataggtatcgtttatgagttatcccgtcttaatatgtgacgtccatgaggctaattttaaaagcataataaatatatgctaattttaacatatatataactatttgaacacctaattaagtagttaagtattaaaaataaattatttctattaaaatacccttagatacagactttatctgaacctaagggtatcttttattataagatattagaaatccatggtaatttccaagccgtaatgatcactaacgacaggtgcttcaccaccttcaaaaactacttgacttgaactgattgaaaggtcttcgctagtaaaaatatggtcaactttaagagcctttttattcccttcccaaccatcaatatcagccataatagtatggtccccaaatacatgattggctatttggtggctatcctttaatgctaatggactattaagaacaagttcataaccctgatttccagtaggattattaaagtcacccatgagtaaaagtggagtttctacctcaagtagggtagtttctagtcgtttccactcctccgcaaatcctttctcaaaccatgagaaatggaggctaactactgtaacgactttgtcattcagagtggtctcagctaccagagcacgacgagtatgataatcagtctcatcgtctacagctgaaactaaaatatcctctggctttaatggtttcagagaaagtatcgctaccccttcatggtacttactataaccaatatgattataagcccatgtccaatgatagtgtagaccttgaagatttaggtaatgcactaattgcaaggcaaagttatcttgatgaagagctggtgtaccttcaatcggatgataatttggactactcttagcaagaggggaagatatgctctggttcacctcttgtaggcagatgatatcatatttttcacggaagatatgctctgctaaatcaaataatttctttagagcatttacttccatccatgaatgagtatttaacgttaagcattttgccatagagtatcctttcatcagaaagaagctgagacttgcccatctcctatcgtttgttacagttcgacttttgccacaactgttttagctatttgtggacctgatttttcaagtttaacagtttttatatctgaaacatttgtaaagacgataatcacacttgtctctttaccagctgctttgatagcttccaaatctgctactacagcaagatcgcctgctaccactttttgaccactagaaattttaacctcaaatggttgaccatcaagagctactgtatctagaccgatatgtactaaaacttctaggccactttctgttaataaaccaaaagcatgttttgttggaaagacactagtaactgtacctgaaactggaacataaatattgccatcagttggttccacagcaaagccatcacccatcattttttgagaaaagacagggtctttaacaacatccaatgcttctacttgaccattagccaccgaaacaatttcttctgttattcctttataagttgtaactggggctgctgctacaggttgacctgtttctaaatcaactattggaataactgtacctgaatctagcaaatcttgaatgtctgatttaaggacatctgctttaggtccgtaaatagcttgaacgccattaccttttaacaccaatcccattgcaccagcttttttccaagctgcttcagaacccacgctatttccatctttaactgtgacacgaagacgagtcatacatgcatctacatcttcaatgttatcacgaccaccaagtaaattaataacttgtacaacttgagaatttgcatcagcagaaccagaagctgttgaaggagcattatcaacctcttcgttatcataattaccattacgtcctgctgttgctaaattgaattttttaatcataaagtttgcaataaagtacatcaatactgcaaaaagaagtgtcacccaaacaaagttgaaaatatcaccaccaaggcccgcttttatgcccataggaacacgtgttaaaaattctatattaccaaatgaatgaacgcggaggttaacaatatctgccatagcaaacgcacatccttgaacgacagcatatacaaggtagagtggcattgctgcaaacatgaacatgtactcaattggctcagtaacacctgtcaagaaagtagccgctgctgctgaaataaacattgacttgtatttcaattttttatctttatcaacgttacgatacatagcataagataatcccatcaaaatacctgaagcaccaatcatttgccccactttaaaacgtgctggagtgacacttgtcaataagtgatggtattgacttgaatttgagccttttaagttaattaaatcaccaacccatgctaaccacagtggatcttgtcccaacacctgtgctcctttagttgcacctgtaaggacagtgtatgtgccacctagttgcgtgtagttcattggaatagttaacatatggtgtaaaccaaatgggagcaataaacgctctaacgtaccgtagacaaatggtgctaatattggagcactgtcttgtgaacttgcaatccatttaccaaagccattgatacctgattgaacaaccggccaaaatactgataaaattaatgcaacaatgactgaacgataaataacaacaaatggaacaaaacgttttccattgaaaaaagttaaagcatctggtaatttacgatagttataatatttattaaaggcagttgcaccaacgaaacctgaaataataccgacaaatacacccatattaagagcaggttgcccaagaacgttaacaaagtaatctgaaactctgatggttgcaccaaataccgtttgaacagttgctttactgtctgctaacatatctgttttaacaccaaaaaagttccctgtaataaggttaataagaataaaggataagccagccgcaaaagcaccaccggcacgttctttagcccagctaccaccaatagccaatgcaaataagatgtgtaagttaccaataactccccaaccaatttgagcaataacattagctatgcgccctaataaaacatttgatggatccaatagactaatggagttaccaatactaaccatcaatcctgctgctggcataacagcaataacaaccatcaaagccttcccaaacttctgccaaaattcaaaactaaagagctgtttgacattatttttcatcttcaatctccttttatgcacttaatagtgcaagcgtttgcgttattatggttttattatagcacttatttgttttttgtaaacccttacttatatattttttctgaattactaaaaaagtctagataatatcatctagacttttatttgtgagtttttattgtttgtgaagtaaaacggtcattgttgttccctgccccaaatggctgtccacttttatactaccattgtgaaaatctaaagcactctttacaatagacaaacctaaaccagtccccccaactatttttgagcgacttttatcgacgcgatagaaacgttcgaaaatacgttttttgtccttctctgcaatgcctagtcccgtatcactaacttctaaggtaattgtatcaggtgaatttttcaaagtcacatttacttgacctttctcatggttataggtgatagcattgtcacacaagttgtacaccaaggaattcaataaaactggattccctcgcaaaatagcttcttctccattaaaattgatttgtatgtgcttcttatctgctttagcttgtaaaccttctaaaactttttgtgttaagtcatacagatttactgtctcttgcggtaatttttcttgttcatcaaggtgagaaaggttgataatatcctcaaccaatttaactaatcgttcagattctttatgaattttagctgcaaattgtgggacttcttcgtttggaaccatttgattagctaacagttctgagtaaccagaaataacatgaagcggggttttcaattcatgagagacattggcagtaaattcacgttgaagttgttccatttggagttgatcagtcacatcaaacagtagaacaaccaatcctgttactcggttgttatctgtagttggtcttaccaagacgcggtaatgattattttcaatgccaatattagcctctttctttttcccttttagtccttgatcgattaagtctttgagagttaaatctcggctaacttccatcataaagcgcccatgccaatcatcattaatttggaataactttaaagcttctgcgttgatactaacgattcttgcttgatcatctaaaagaatcattccttccttaattttagaaataatggtatcaaattctttttgacgcttttgtaataacagtttttgatgttgaatcttagcctgatggctatcaagacgccttaataatggtgttatctcctcgtaactatcatttgataaaggatgatctaagtcaatattgtttaaaggctctgatactttttttgctatatatcgtgcaattaatacagataaaataatagcaagtaagatgataattgctaagggacttatcataccaaggagaagataaaaaatagtttgttgcgcaactgataaacgaactatcgttccattatttaaacgttgcgcagcatagatagacttctcagtaagtgtcgctgaccacctcgtgctctcaccataaccactcttgatagcttctttaatttcttgacgattggcgtgatttttcatatgttttgcatctgattgggtatcataaagcacttgtcccttattatctacccaagtaatacgcacatttgaagttttaagattttcaaaataatctttaccttcaaaggaaattccttgtgacgccagtgccgtttgtgttctcaactgttctcgctgaatgtgattgaagtaattatagagaaatcccataatcatcaaaattgtaactaaaacaattcccaaactagcagataaagttgtacggaaaatttttttagtcatgtctttcctccaaacggtatccaactccccttactgtagcaatcaaatagccatcctcaccaagttttgttcgcagtgtcccaatgtgaacatccacagttctagtttctcctaaaaattgttctccccaaaccttatccagaagttcttgccttgtaaagactctattgggattacggaagaataatactaataactcaaattcctttagggttaagtggattttttccgttccccttttgacccaataattagtcggatcaatctctaaatttccaatgataatatgagcttttgaatctacttggcggctacgtctcaagactgcttttattcgtgaaatcatttccatcatcccaaaaggtttgacgagataatcatctgctccaagatctaaccctttaactttatcatactcactacctttagcagttgtcatgattactggtatcatttccgtttgatgttttctccttaaacgctctaaaatagtcaaaccatcatctcccggcaacataatatcaagcaaaatcaagtctggaactttctcctgaatagcttcccaaaaaagctctgaactcgaaaatccttgagctttaaaacctgccatttgcaaagtatagagcatcatttcgcgaatatcagcatcatcttcaacacaatatatcattacgcttctccatctaggttacctgttattgagaaaagcacccacttagcaatatttactgtatgatcaccaatacgctctaggtacttggcgatcattaaaacatctatgggatattcaccatcaacatcctgtaccgaaaaatataacactaactgtttctttattgtatcaaattcctggttaactgtcctatcttgttcaattacttgatgcgcttgttcttcattgtcataaataaaagcatctatactcttagtcagcatactaatgacattattagacatgctgttaagttgatccctttcagaacctgaaccttggataatatgacctaaactaacaatttccgcaatttcataagcttgagcaccaatacgtttcatatcataaaccatttttaatgcagaagaaatacggcgtaaatccttggcaactggttgctgacggagtaaaagttttaaacatctctcctcaatatcccgttccatttgttcaatcttgtgataagtttcagaaatatcgtcaaggtaaacgtcattactatttgttagagcacctaaggacttcccaatgatgtcctcacacaatgcccccataaaaataatttctttattaaggtcattaagttgacttgcaaatcgtgaacgaatcatccgaatctccctgtaatgtagttttctgtacgctcatcttgtggcaatgaaaagagttggctcgttttgttatattcaaccacttctcccatcagaaagaatgctgttttatcagaaatacgaacagcttgttgcatattatgtgtcactataacaatagtgtagttcttcttcagttggataaccaattcttcaatttttgctgttgaaataggatccaaggcacttgtgggttcatccataagtaaaacatcaggctcaatagcaagagcacgcgcaatacacaaacgttgctgctgtccgccagacatacccagagcagatttgtgaagacgatctttaacctcatcccatagagccgcctgtttaagggaacgttcaacgatatcatctaactctgctttggaatgaataccgtgcgttcttggaccaaaagcaacattatcataaatgctcattggaaacggattaggtttttgaaacaccattccaacctttttacgcaattggttaatatccaattgtctatagacatcctcgccttctaaagtaatatcccctgtgattttgcaatttttgaccaaatcattcatacggttaatacttttcaagagagtagactttccgcacccagaaggtccaataaaggctgtgatttctttttcttcaatgtctaaattaacatccttcagagcgtgaaattctccataatacaaatctaaattattaattactaatttactcactgttcgactcacttcctaatcgtttggctactagtccagatacaaaattgacaataataactaaaagcaataagatgaccgcagtcgcataagtttggtcaacatataagccctcacccgaaatagcatacatatgtactgctaaagtacgagatgaactaaataccgaatgtgctacttttgcaactgttccagctgtgaaaataagtgctgctgactcaccaatgatacgtcctaccgctaaaataataccagcaaaaataccagacatagcactaggtaatacgattttaaatatggttctcaatttaccagcaccaagcgcaaaggctccttctcgataagaatccggaacagatagtaaagcttcttcagttgtcctcataatcaaaggtaaaatcatgatgctcaaagtcagagaacccgatatcaaagataagcctaagtgtgtgtattttacaaaaaataatgcaccaaacaaaccataaataattgaaggtatccctgccaatgtctcggttgcaacacggataattttgagataaggattatcacgtctagcatattccgttagataaattgatccaccaataccaagtggaactgcaaataataaagttaaggcgatgataaagatagtgttaatgaaagctggtaatagtgaaacgttctgagtattataagtccatgcaaacaagccagtattcacatgaggaagccccttaactaaaatataaataacaacaaatgcaattgtagcaaaacttagaattgctcccaaatagacaatagcaaaaagaaagaaggaaaggggatctttttttaaagatgctaaatattgttttgacgttctttggttaatattttccatcttattcctctttctgtaatgctgaaaaactgatattaatcattaatataaagataaagagtaccacagctgtaccaattaaggcttgacgatgcaaaccagaagaatagcccatttccataacaatgttagtggttagagttctaacgcctgatgtcagcgattgaggcaagacagcttgattacccgctaccatgatgacagccattgtttcaccaatagcacgtccaattcccaaaacaaccgatgctaaaatgccacgtttagcagctggtaaaacagcaaagaagacacttcgttcatgagaggcaccaagggcaataccgccttcataatagctctctggaacagctcttaaagaagattctgaaatgctaacaattgttggtaaaatcataattcctagcaaaattgaagctgctaagactcccataccaaagccaccaatatattgccttatcatagggacaataacaacgagtccaaagaaaccataaacaactgaagggattcccgccattaaattgatagctgactttaaaggcttataaatattttctgggcagaaataagccataaaaacagcagtaaggatacctatcggtcctcctaaaagtaaagctcccgctgtaacatataaggaacctacaatcattggaaagatgccaaaaatattattactaggatgccagactttaccaaatataaaatttccccagccgattttcgtaatagctggaagaccactagagaagagaaagaggcaaattaaaatagctgatataacactgacgcaagccgtgatgaaaaacacagcttgcataagaccttcttttgtttgtttcattgtttactcttaccttactttgataagtcagaccaagacgttgtctttccagtaaaaatgtcttttacttgttttgttgatagatcattaactttatttttcttattaacaactactgcaataccatctgttgcaataacagtagctttgacccctttggatgactctgtcttatccaattcacgtgatgccatacctatatctgctgatccatcaattgcgcttgtaatcccagttgaagaatcactttgttgaatttcaacatctacttttgcatttactttatgataggcttctttaatcttttccataaccggcgttactgaacttgaacctgctataacaactttaccagatgacacttttgcttgatatgctttagcattgtcaagtggaatatagccatttttctcaacgactgcttgcccatctttgcttaagatataatcaataaaatcttttgttgcttctttttccttaccttcttttgttacaatattgaaaggacgagaaatcttatagcttcctgatttaatatcttttacagtcgcatttttgccatcaattttaagcactttaacgctactatttaatgaacctagtgaagaataaccaatagctgacgggtctttagagacagtggttagcataactgaagttgaattggtaacagttgctgcatcagaagtatggtctactttttcgccctttttattttttgactcgatcccaaataactctatgaaagctccacgagttccagacccttcctctctagaaacaatgttaattgtccctttagatgaagatgatgaatcatttgagcatcctgctaggatgccaattcccataagaccagataccgccaaaagagatagcattttgtgttttttcatgatgaactcctaaatattttttgatttgattttattatagttaagaaatatcaaatctctttgaggatttttgtaaaatcaatgtaaaattaaaaagagttggaaaattatccaaactccttttttctattatggtaattcagccagtaagtcggattgaaacagttgttacatcacataattggagtataactatcccattatagagttaacttacgaatgatgtcaatgattttttcagccacttcctcagcatttaaatgatttgtattaatatgaataacattggaaaatgtgtctaaataatgttttttagcaggcagcaggtgatgagtataccatttgaaaaaatgacgctgtctattaaaatcatttttttgacgttggtataggaccgtctcatctgcatctagaaaaataatataatcagcaaaacattcctttagcctatttacctctagtaacaaattagaaggtaaagtccaactataacccgccacctttggaaagtattgtgtataaaaagcaatttcctcagctccataatccattaacactatttcattatctctaacaagttcgtatctatctcgctcatgctgaataaatagttgttgaatttcacaataatcgtctaatttattgttatcaagctgatgtttattaatcttatcaactactggagaaatatcctcaaaactaatagcgattttggggtaaacattctcaatgattttcaaagctgtggttttccctacagccataccaccttgaatagcaataatcataataactccgctgagtaactaataacacttagagcatagagcggcgctgtttctgtgcgcatgatgcgtggccccaagcccaccttgatagctccaacctcttcaaaagctgcgatttcttttggagaaatgcccccttctggtccaaagatgaagaggagcttgtcacctgcttttacagtctgcaagttctgggctagcgctgacaattcaccctccttggcagactcttcataggcgataaaaatcttatcaaagcctgcaagctccgcttgaaaatcagccttcttctcaaataaacgaacctgaggaagacgattacgcttgctctgctccgctgcgcccagagcaatttttgccagcttatcttcttttttagctagtttcttgccgtcccacttgacgactgaccagtcagctgggaatccccagatagccgcagcacccaattctgttgccttttgcgtcacaaaatccaacttgtctcccttgggaaaacctgaggcaatggtcacttgaactggcatttcaacattgttgtctagctcttctagaatttggaagcgatgagcagagctgtccaccacctttgccagacgcttgatggcatcatcaaaaaccaagaccacttggtcatcttctgtcaatcgcatgacattgaacatgtgcttgatggtatccttgtcctcgatggtcacataggcacctgcttcgccatttacaaaatactgttgcattagccgccaatcactcctgaaatatcatctgtctttttgaaaacgcaggcattccactcaccttgaaccatgtgagtctcaaggaagaaaccagctttttcagcactctcacgcaccatgtcccacttctcagaaatgataccagacatgatgagatagccctcatccttgaccaaacggtaggcgtcgtctgtcagatggatcaaaatatccgccaaaatattggcaacaataacatctacctcttgctggacacctttgagcagatcaccagcagccacatgaatattttcagtgccagggttcatatcgatattttcctgagccacgcgcactgcaacatcatccaaatcataggcatagatgtccttggcacccaagagagagctagcaatagacaaaacgccagaaccagtccccacatcgataaccgtctcaccaccacgaagcacttgctccaaggcaaaaagactcatcttagtcgttgggtgagtcccagtcccaaaagccataccaggatccatcttgataatcttctcaccagccttagcctcgtagtccgtccatgacggcacgatggtcaaatcatgggtaatgcgagctggctcatagtacttcttccagttatcagcccagtcctcttcgaccaattcctgactgtcaaggttgacgctacccgtcgcaagaccaaagccttcaaaattagctaaacgatcagccaaatcagccttaaccgcctcaatatcaagcgtatcaggataataagcagtaatagcaatcatatcagactgctccacctcaggataaagctcaccgaaacgatcctcctgtccaaggtagtcagccgaatcgctaatggcaaccccctgactgccagtttcaatcaataaattcgagacagcttcctctgcctcacgattcacgtgaaccgttagttcattccatgtgttcatgtagtaactccttcattatttctacttaaatcaataaaatagttcaactgccatcgctgtgtcaccaaagctgttctatttaaatcgctacaccaaggagggtaaaatcgcatagccatctttccttgagagttagcagatgaaagaatacccttactcactgcaacctctttgggaatgatgaacaaacctttccacctaccatctttaatgacaataatcaaatcttccacttcatcttgttcataaaaaggaatatttttaccatttccatctttctgccaaaatactgtaaaataccccatcttgctagctgtcttatgagctaaacgacaccttttatagtttccatcgccttcaattcttatgaggataccttcatatttttcattccacttttcttctttaacttcaaaggaagaataccattccctaagtagctcaactatttctataactatccctcctttatcttcaaatcaatatgattaaccatacttttcaaaataatttattttttgcttgaccctgaccttaggttatcctttatactatgtaagtgagaggaggttattaccatgaaaacagttaaagaagtcagtatcttaagcggtgtaagtgtgcgcaccttgcatcactatgataaaatcggtttattcccacctaccgccctatccgaagcaggctatcgactttatgacgatgaagcattgattcgcctgcaagaaattttgctatttcgtgagttggaattccctctcaaagatatcaaatacctgcttgagcaagcaaaagaggaaaggcaagacttattagcccaacaaatcaaattgcttgaatggaaaagatcgcaccttgagcaggttatcacccatgcgaaacgattacaagaaaaaggagatgattatatgaatttcgatgtttataataaaacagaattagaacaattacaagctgaagcaaaagaaaagtggggacaaacagcagcctacaaagaatttgctcaaaaacatgcttcagatgactttgcacaaattagccaagaaatggcaaaaataatggtacaatttgggcaattaaagacacaaaatgtatctgatgaatctgttcaaatgtgtgtgaaacggctacaagactatatctctcagaatttttacacctgtaccaatgaaatccttgctggactaggacaaatgtatcaatcagatgaccggtttagtcaatcaattgacaaagctggtggagcaggaacaagtgaatttgtcagccaagctattgcttactattgccaataaactatcagaaaactagacaatcatctagttttctttttttattctatcttctttgtcatatagaccatatccattccttcttgctcaggttcggtatgggttgaatgataaccacatttttcataaaaactgaccattagtttttcttgcgcaatcgtacataaatcccactttgtaagcttaggataggttttctctaataaagccatcgctgctgagccgtagccctgcccttgatattggggaagaatagccgccgtaccaagccaagcacgcttctcctcgtctttgataaccaatctaagaaaaccaacaattgtctcatcaacaaggacaaaatgatagaaacaatctggtcgctccactagtttccatcgaatctgctcaacttcttccacatagggatcgtattgatcgtggtatttctcatagactgccttaaagctagctctctgaatggcaataatcttctctaaatcactagcttccgccttttgtaaagtaatcatcttccacctccaaataatctctcaacctctcctgcaactgaggaatgacctttttatggcttaaaaattcgtcaatggacatgagtttgtagtcttgtccttcatcgcctagaacaatgctatcgtactctttctgactgatatgtccaaccataaaaactgataatttatcaggcttcaacatacccctataagtcttgacccaatcaatatggtttcgagttaaggtcagacttaattcttcatcaacttcacgaaaaagacattccaaaggtgtttcattgtcctcacgaccaccgcctggtaagtcccaaaagcctgcatagggcaaatctggaaaatcatctcttaggctggtcaaaatctttccctcgcagaaaagagcgatctttgcacctgagaaatcaaataactcatcaaaaatatccatgcaataacctcaattctattcctaaagctccatattttctgatttgttcaggggcataataacgttccatatcctctggtctggctgtttctatatcatccaatgtatatccacattttagcaaatccatcaagtctaatatctcggataagggtaaaactctgtctctttcagttctgctctgccattttcaaaagcatccgtatcccaagaaagaccgaactcttcgatactgtcatcggtgaggaagtccatgaggtcgctcaacccttcagtggcaacctcgttgagagtctccgcaaaataagccagaaactcacgcgacaagcccttcttaggctcataggggatagtcaccagatagtcctcagcatcaaagcgagacttgacagggttgtaaaagagtacatagtcctcaaaaacgatgtcctcgctactcgtctccccctggtcgtccacggtttcaatagcagagctgttttgtgcttctaatataaaagtgacttctacagtatgatttttcttatcccaatccatggcaaagtcatactgtaaatgcttatccaattcttcttctagtaccgataaaaatccaaatttagccatcttatgtccttattttctatttattctttcttattataacatgaaatagaagaaaaacgttacagactcaggttaatcaaaaggtagttcctacttatttttatgttacaatagtctcaaagactagccgtttttgactgacttcatactatgttaaaagcgtcagccaagagaaaaactctatatagaaaatagaaaggatttgaatacgggactaattttctagaagaaaagatgaacttcctaatgtctgacgacacttcgtcgttccctatttctttacgaaaattttcggtaaaccgaaccgtccctttgtatcatcaattatgattatcagacctatgcaggactgcgaccgtgaggcagttctgaccttacaaaatactggctggactgctcttacctctcctgtctatgaccgcaagtggactgagagtgatttggagaagaatctggcaaatggcatgtccttctttgtcgctgaggtcgatgataagatcgctggcgtcttggactttggtccctactatcctttcccagctggcaagcatgttgccactttcggcattctcatcgctgaaccctaccaaggtcagggactgggtaaagctctcttgaaagctctgctaactgaggctaaagctcaaggttacatcaagattgccatgcatgtcatgggcaataacagcagagccatttccctctatcaaaaatacgggtttaccgaagaggctcgaatcactaaagcctttttcattgaaaatcattatgttgatgctttaattttcgcaaaagatttggagaataatcatggctgacaatcttgctctacgtatgcgtcctcgcaatattaatgaagttatcgggcagcaacatctcgttggtaatggcaaaattattgatcgaatggttgcagctaatatgttatcttccatgatcctatatggcccaccaggtattgggaagacttctattgcttctgctattgctggtactactaaatatgcctttcgtacttttaatgccactgttgatagtaaaaaacgtcttcaagaaattgcagaagaagctaaattttctggtggcttagttttattacttgacgagattcatagacttgacaagacaaaacaagattttcttttacctctacttgagaatggcaatattattatgattggagcaacaactgaaaatcctttcttttcagtaactcctgccattagaagtagggtacaaatttttgagttagaacctctttctaacgaggatattaaaaaagccattcagctagcaatttccgataaagaacggggatttccttttttagtgacaattgatgatgaggcgctagattttattgttaccgccacaaatggagacctacgatctgcttataattccttggatctagcagtcatgtctacttctcctaatgaagatggtagccgtcatattagtctagagacaatggaaaatagtctgcagtgtagttatattacaatggataaaaacggagatgggcattatgatatcctatcagccttacaaaaatcaattagaggttctgatgtcaatgccagcctgcactatgccgctcgtttagtagaagccggagatttacctagtttagcaagacgtttgaccattattgcttatgaagatatcggcttagctaaccccgaagcacaaatacatactgtgactgcattggaagctgcccaacgcattggttttccagaagctcgtattcttattgctaacattgttgtggatttagctctatcacctaaatcaaattcagcctatttggctatggatgcagctttagctgatttacgtcgttcaggaaatttacctattccacgtcacctaagagatggacattacagcggtagtaaaaccttgggcaatgcaagggattacaagtaccctcacgcctatcctgaaaaatgggttaaacaacaatacttaccagataaactagtaggacataattactttgaagccaatgaaactggtaaatacgaacgcgcacttggttcaaataaagagcgcattgataagctctcagactgattgctagttttaaaaatcgcaatcgatttcaaaaatcgataattttgcttgaaaattttataaaaagtggtatcataaagacatagaaacattgctgtggcatacgaatccacatctaagtgttgaccgactatttctttgtatttcgggaaacgaagtcatctctagtgcgcaagccgttaacacgcggaagccacttaaagaggtgcgagttacccacctgcttattttgtgcgggatcaatacaaaaagtggatcatcggtgccaatacagcttcctagcctccttagctcagttggtagagcagtagactcttaatctatgggtcacaggttcgagccctgtagggggcattaaactatacataaaaaagcctttgattaaaggcttttttgcttgtctaaagtggatttgtcccatcttttgtccccgaaaaattttttaggatgaaaattattttcttctgtattatttcgttgagacaatatacatataaatatcactttgtactaatttaaacttcacttttctcaaaaatgactttagcagatatcaaactgattaagataataccgatgactaagagagttggttgtaataaatctttgatgtcatattgaccacttaggatttggctttgtttctgaatcaacaacatgggattccattccttggtaactttgaaaaagccagagatgaaaaaggctacaatggtcatcagacaagctattaatacgcctgcagttttacgaaagattacagagtaaaaaagaatgagactcagcaataataatccaaagatccaggatgtaccgtaaacaataagtttatgctgaccatgattattaaaataataaagtgtataagcatactgggtaagtgatcctagtatatagctgatgctccaaataagtgtcatcatgataaattttgctaagataatggcttttttgcttagtcctttggtaataagattaataagtgtacctctggtaaattcttgagtcaaactaccactaaaaagaaaaactaatagaatcaatcctagctgattaatatttttaaaatattgactataagaatcaaggtaggttgggtcaggaatagcttcttgcagtttcttaggcaaaatccctgccatgatttctggcatcagtaatgctgtgagtggtcctaatattccgaaaatgattgaaataaggagaagggcaagagctttatgactacggctattttctagccactcttttttgagcatggggatcaatccggtcatttaatcacctccaaatagaagtcttccaggctatcttccagtaattcaatgaagtatggcgtgatttcttgctcaactaaatacctgtaaaaacttgctaatgcttgttcacgattgtttgcctcactcaattccaaatgtaccttataatattgatctttttgatttaaaggaaatcgcagagctaatttttgtgcttcattgtctgagacttttattaaaaggttcagttgattcacactggctgacgctttgtctcttagatcttctagattatggatacctgattttgttagaattagaacttgatcacagactttttccacatctgataagatgtgtgtcgagaaaatgactgtcttttgaccacgtagttgagaaataatggagaggatttcttgtcgtccttgagggtctaaggctgatgttggttcatcacaaatcagaattttaggattgtgaatcagtgcttgggctagacctaagcgttgtttcatacctcgagaataggtgctaatgcgttgctgattatcggctaagccgacctgttctagcagatcagcaattggtaaactggttttgttttgagctaagccagcgcaaagttgtaagtattcttgtgccgtcatatagtcataaaactccggaacgtcaggcaaataaccaataacttgattactttttgtctgcccaaaagtcactgggtttcccattactgaaatggtaccagagtctactttcaataaacctaaaatcatcttaatggtggtggttttaccggccccgtttggaccaacaaagccataaatcttattttcttctagctctaaggaaacctgatttaaaatgatttgatccccaaaggatttggacagattttgtaaagaaatggctgtcatgcatttttcccttctaagctaagaaaagcaataggtccaaggagattaacaaaaaggataattagaacccaaactggtttagaaaggtagtttgtctttgttatttttcgtaattttaagagtgcaatgatgataaggataacctgtaagaggataagagggataaagaaaggtaaaaattggctagggatgttagtgttcatctgaaatctccttttcgagtttttttaaagcagcaagctgagcttggaaggacttttcttgctgtaagtattgaaactgtggactatgaaacagggcaattaccctttggattaagatttgagaattggttggtggctgaattcctgttggtaactgttggagccaaggatcgatggcatcaaaaaagctgtcgccatgcagttcaaattgttttaataggtttcgggtagcctctgccaattgatttaagtaactaattgctttttggggctgactttcagcgaaataacaggccaaactgtagtaagaggaaatggctgtattaggatgaagctttttgaggtcaaatgtggccataagattttccagtcgttccaaaatgaattcttgccgttcgggacattcaaaagccgttaggcttaacagatattggcaaatcagcagaatttgctggtaaatttcaacttgtaaaacttgttttgcttgctctgtttcccccttagcagcgaagctattggccaaaaataactcctcaccaagtttataaggacgattctgataaagtgcgataatatcatcgtattttttttgttgaaaaagtattactacttttaacatgatggcagactgaagttcagattcaacagttgttttgctgataatccgattgattagttctaatgaccaagggttactatcaatctgagctggattgctcaaaaccagttggacgaggagtaaaagggttttgttatcattgatataatgttttgctaagtcttgaatgttatgaaagaattcagtcccattttgttggtcaatttgtcctcgcaattgttcaaaaagatgccctctttcagagtcagttagtgttttttgaaaacctaccaactcatctaaagtcatatcaaatagttttgccattagaatcaagtaatcgatatcaggttttgcctgattgttttcccatttggaaattgtagccttggttaaatgcaaatagtcactcagtttttcttgagtcataccaagacgtgtgcgttcaaataaaatagtatcaccaatcattatgaacctcctttatttgttattataatgtttcctaaatgaaaaataaagttcctatttagaaacaatcctagtaagaagattctgtttaagaaataaaatttctttcatgtcacagtacagtacatcagtcaattaaaataatttatttccgtcctttttaaactgtagggaatcatatgacacattaaaaatttttgattaaaggcttttcgcctatctaaagtagatttgttccatcatttatccccgaaataaatttgaaatattgttatattgtactcatctcaatcacgaacaatataattgaaaaatggctatttttgcttcttttaattagtagtatgatataattttgtaagatattttgggaggttaaattggatataacagcttatcaaaaatgggttagtgaattttacaaaaaaagaaattggtaccagtataattcgtttataagaagtaattttttatgcgaagaggttggggaattagcgcaagctattcgaaaatatgaaattggtcgtgatagaccagatgaaatcgagaaatcaaacaacgaaaatttaaacgatatcaaagaagagcttggggatgtattggataatatttttattctcgcagatcaatataacatttccttagaagaaattattgaggcacataaaaacaaattagaaaagagatttgaagaatgaaaataactgtcttttgcggtgcaagcaacgggaataacccaatctacagtcagaaaatagtagaacttggtgaatggatgattaaaaataatcatgatttagtttatggtggcggaaaagttggcttaatgggagtaattgctgatactgttattaataatggtggccaagcaattggcgttatacctacatttttaaaagatagagagatcgcccacactaatttatcaaagcttattgttgtcgaaaatatgccacaacgaaaagggaaaatgatgtctcttggagaagcatatattgcattacctggtggaccaggaactttagaggaaatttcagaggtaatctcttggtctcgaattggtcaaaatgatagtccatgcattctttataatatcaatggttatttcaatcacctagaaagtatgtttgatcatatggtctctgaaggcttcctgagtcaaaatgatagaaataacgtactattctcagacgatatcattgaaattgaaaagtttattaaagattatcaatcacctacaattcgtaagtatagcaattaaataaagaaaatagccatttatatttggctattttctttattctagttaccatgttattctaacttttcaattttattcgaaaataaagaatcatactcagaaatatcttcatctacaaaaaattcttcaatagcttctttattattgatatttagttttttacctatacttttttgttctaccaaatttttaaattcttcatctatcatctattagcacctcgttattaaactatcaccatagttgttttatctcattgtactcttcttgaattttttcttcaagagtatgaccatagacttcaattagcatagaaatatctttatggccaagaattttcgcaataattcctagatcatatcctctatgccataggaagcttccataggtgtgtctagcaccttttgttgtaatgatgggttctatattcaactcttgaacgatgcctcttaaaaccttatttgtaccgtttgtactcggtacactattaggataaccaaaatgttgaaataccatattgtttgtattttgtaatccaagctctttatttgattgattttgttcaatcttaagatttttcaagatttctagacactcattatcaactggaacaattctgattgaggttttatttttaggtggaacaaactgacttgtttcagagttaaatcttctatatgttttaaagattcccttatcaaaatcaatatcttcccaagttaaagcaattaattctccgtatctcatacctgtttttaataaaaaatagataatatatggtactaccgatttcttataattgaatttatcttttacagcattaatgagatccaaataagctttttcactatgaaggtatttactatctgcatcctgactttttactgttgagaataattctacattttgagtaaaatcttctatcataaccttatcagcaatagccatttgcaaactctgtttcacgccagtatttaaccggcctaagaaattgcgactaactcgttgtccatagttattcataattcgttgatattcactaggtctgatttgagaaatgggtttatcaccaaatagcttttcaagcgttaccttccgactaagatatttctttttagtcacatcacttctattactaggcatgatttttaaatctagccattcttgataaagttctggtaatgaaatattttttgtgattatgctaccagttctcaatttttggagaataggctctgcttctgcctctgctagtttctttgttttaaagccactattataagcaactgttttaccttcctctcggatttcataagcccataaattctggtttcctctccttctatatcttgcatttgccatatgttatacctcaagtccaatcacttctgaaactgcacttctagggacaaccataagacgtttacgatcatagaaagtataaccacgttccaccattaaatttctagcttgatggataatatggtttgctgttgaaggacaatagcccatttcaattaagtctttattagtcattacattatttgtcattgtatttttttcctttcgtgttataatttatctagaatattttttctatgtcgacttctttcacaagtcggctttttttatgccccaatattcagagctttgctgttcacgtacatattgttcaatctccttttcgtcattatcagtaaacttttcaactcccctgcgaagtaagtcttgtaaaaagacctctgcctgatcgataccgtaggcttcgtattttgccatataaacctttgcaattgtctttgacacttgtttatcagtccacgcttcagactgccttaatgttggtttttctctcacaatactcagtcgtgttttctcctctgtattgatatagttttgccaccatcttacagattctcttcttcgtttatttttatctcttgcttttggagaaacaaaacggtaatgtccattgatagcctcaaaatatatagaggcgagagggcgcatatcatttagctgatgagcaattagattagccttctcttgccaacatcttagctcagctcgaacccatgaattaatgtcaatatccgtctgtaattttccattttgctccattaatttattataaacacaccattgttggtttcctcttgcaccaaagacaactgtttcaccaacgagttcacctgaatcaataacgaatttttcatggtactctgcatgtctcgcagttgttatacataagccttttttactatactcataaagcctttgaacatttaacgactcatcaaaaatatcattcgcaatatctaatctggtaaagttcgaattattatcaattagtctctttactaaactagtccaattattatcattaccttctataaattcctcatactgccgacagccttgtccttttagttcaacatgaactcccatgctactattaggatctaagttaaagtaaacttttatctctgaacaagcatagtgacgttgatacttattgactccccattcgttcaaagtaaaattggttaaaggtattaataaaagtttctctattacatactctggagtgacatcttttactgtaacagcgaaataatctatcttaacgctgttaaacaatcttattcacctataattttgatatctgaggtagtcagttttattccaccccaaccttttcgatttatattccatgctagacgaacttggggattaatcaattcaatcgttttttcaataagcccatcattgcttgcaattttactaatcttatcaagattatccaagatttctaatggaattgtttttaagtcgtcggcagacattcccatttcttttaagactttaactttttccgcatcttgtacttggcaagttatttttgaaatttcatcagtttgaactgattcaccattgatattattatatttattgttaatacgtgcggataagataattacttttttgggaatttcaaattgagatttttccaagtttaagtcacctagacttactgtatctgttaatttaattgttgccatttttctacctcattttcataataaattatttgcatcttttcttcctgtacacgaaagttactatcagctctactctctcaatggatttcagcatttaatggtattaaactaccttcaccccttatgtatcaagggtttgagcactatttcatgtacgtgtgtaccccctattagtagcggggtaattattttcatataaatttcaaaagaattttcacagattattaacttatcaaacttaggtttgtcctcgagcactctgcttttatctcccgagtcgctatggcttccagcacctcgctcctcgttagataatcgattgctctcagaaacctcgcttaagtttgttaaatatacctgaatccttctcattttctaaaatgtttaatcgctctgtcagctccttaacctgtttctgtaaagactgattatttttttttaactgaaacatactatcttctgcttcaaataagaatttatagaaatcctctgatagcattttcaattcattttttatatctcgttcggactgagcttttgagtcgccccagacttctttaatagagtcatctaaattctttgtcttatccactaaatgagataagacaataaatttagtaacttctacttctgtaaaatcaaagaaaacttgtgtgctacgcttagaaactcttctcctgacttttttaaatttgtatccagataacatttcaattcgtaaacgccatttcttgattgtactaaccgacttgtttgtttttaaagcaatttctttataatctatagcattaccacctatataatatatttataccttattaataagatataaatatattatattcttatccaatcaaaaaatcaagataaaacttgcaaaaaagttatatcctgataaaataaattatatacaatatacgtgagggaaaattatgacatatataattcaaaatttcggtccaaatttgactagattacgaaaagaacgtggaatcagtcaagttgaactttccaatcaactccaaattggtaagcagtcaatttctgattatgaaaagcaaaaggcgtttcctacatttgctaatctagataaaattgcagaatattttcgtgcaacccccactcaactattcggaaccataaaagaaattgagctagagaatagtgtcttagaaacagatacttatacttcaaaagcagatcatattcttaagtctgttaaagaattttatgaactaactaattatcttaatgattttaatagcccagaattttacaccagcgaaacaattaataatttgtatcatcttattactccaaaaccaatattggatccagaaactgatgaacaacttatgagatttattccaactggaaaactagtacgagcagaagatattagcggaaatcccgaagactatgaattggcatttaaaccaagtccacttactcaaactttaagtagaatagatgaaataaatgaactttatgaaaaagtaaggtttgttgaagcttttaaacataataatgaaactaattctagataataatatatacaaataacagaaaacctaaaacgatatataatatttttctctttacaatagtaaaaatatactgtaaaatggacgtaagataaaaacagttattctcatagcgcttgtttatcgtcgtccaaaaaaagtccctcattgcatagcagtgttgggacttttttatttagtaatgcaataaatcaaaagctttcaaaaatcttcgtctagacgtttcaaaaattccttcatcaattattttttcaactagcaaaaataattcttcttttggaaaatttttaatatgagttgctataaaattatatctaacattgtccggtacgtcagcttcaagtatgccaacaatttccgtttgtctttctaacgtttttgagtgtagcaatgggacgccaatactactagtaaagtcatctaatgatagctcttcttcctttgataatctttttttaatgttttcagtgtacttatttgaatctttagaaatatattctgacattgcaaacatatatttttttattggaagatgacttgctactggttgggttgcaataaatcgaataacaatttcctgaggaattgtttctttatctagaaaatatgatctaacatactctttaaaatctggaaacttatatatgtatctttcatccccaaaggcaacaactatatttttcgaacgaatttcatcctctgttaggtttgctaaatcttcataactagtcaagacagtttttaaatctttgctctctcctttaacttctattatttttcgaaatacattttcatatttcgctatttccgaaggtaaaaatccttgatttatcttagagattaatctataaatattggtaaaattatcagtttttaaacacgaatagtaaacgcttaagtcaggtaagcttgagaccactgtttcaatagattcagaatctggtagatattcaactacacctattttttgagctgattccgatatatcaaaaggactattttctgcaaaatctgtcaataattttctaatattttcatcagttaatgaatagcccaaaaataggattggtgactccaccaaatttgaaagtatttttgcattaattaatgctgactttgttacattcttttcatagtcttcctttgttatagttattgttgaagcatcatctacagttccatgtatcttatacaattcaccataatcagaagactttaaaaatagccccttatttcctacattaatcttcacactgacatttattgtttttaaacactcttcaataaaattatcgtaattagttgtaattattattcttgctttagataacatttgagaaaattgttttatctcctcaattttctcttcccgaatttttaagtttgagaatctatttgctactaactgtttaaatggagatatatttaattcataagctgtctttaagtctaaattatcaacttgaatattaccatttataaaagcttttgacacttctttttctaataatgaagctagattagtataaatatcaaaatcattgttttcaaatctttctcttaattcgaaggcttttgcataatatgattcttcatcaaacaactctagccatatatcttttaatagtttctcccatgtcggtgcattctcaaaatatctttgagtaatacctgaaccaacaaatataattgggaattgattgttttcactgatttgttctataaaattcactagttcttgtcctcatcttttattaattattagcttgttcaactgttaatcttattataacatcttggataccattttattaatttttattattaaaccatatactctaaaatataattgtcccctttttgtcccacattattttttctaacaataatacttcaaaaatttagctaaataaaaagcctttaaaatcagcattcttgattattattatcacaaaaaattgtaagaaatcgttgtagggggcattaataatattgtcaaaaaccttgattttaaaggtttttttctttgtttcagcagatttgttctagaagatattctttaaaaattagctttaagatactaaacttctgaccgtttcatattccttatttattacttctgtcaagacgtgaccataagtttcaagtaactgtgtaatatccttatgacccattaatcttgcaactacccaaatatctacaccttttgctaataagtaacttccataagtatgccttgcacctgttgcagtcatttttgaattaatatttaatatttttaaaacatttttaagacttttatttatcgcactatttgtcgaaacaccatatctatagtcataaaatatttgattattcatgtttacaatttttaagtttttcaacataacttgctgatcatccttcaaatctcttaagattaatgctaaagattgactaataggaatagtgcggatagaagtttttgttttaggtggactaaaagttcccttatcgccactaaatcttcgatacgtcttaatttctagatcttcaaaattaacatcatcccaagttaatgctaaagcttcacccactcgtaaacctgttttaaatagcaccagtaataaataataaacgatactatttgaataatccaaattgttttctaaataagatatcactttcttgtaatcaaaaatactatgtagatatttatcatctgcatccttaacaaatttcctaccagctatgacaactccatcagtaaaatcagataataagacaccatctcttttagcaaattggatagctttttttatatctgaatttaaccttctaacatggtttttagtgtatttttcagcgtacgtatttaatttcctctgatacgcactatgctttattttatttactttctgatttccaaaaagtttacgaataacagaacctcttgtaaaatatttgttctttgtagtctctgctagattgctaggctttataattaaactgtaccattcaaaccacaaatcatacaatgttatatcagaagatatagaatttactaataacttttgttgctctatcctcatagcttcattcatagcttcacgctttgtcttaaaacctgaaccagaagcaactaactcacttttttcattgaatattctataatcccataatttctttttacctctttgtctatatgttgccattttactcctttcttagacatcaaggaatttatcctcaatattatatcatttaactatttaataaaatagaaccaaaattatcttcaaaatattttctagcttttgttgctaatattttatatcgactacctttacctttcggataaacaataaaaccatttggattaattgataaatctacttctttttttatatctggatttaacaaaatatcattaatcaattttgaccttccaattcccaataactcttgcaagttatcaatatcccaccacttgccttgttcattatcacttaataaatttaaatattcttcttttgaaataataacaacatcatctggtacaggaacactcacattaaaaacctgttgcatactcatcctccttataacttgcttaatccgaacgttatttgttccaggtaattaggttttccactttaaaaccgaactatttttcagttgcagttttaatttaaaatccatatcccccgaacattattctttaataaaaaaacaaacaaaaaaagccatgaaattaatcacaactttatttctatcaacttcttatccttcaagatcatttaatattcttcttaaagtactttttatttcttctgcttcgctataaccgacatcctcaaacctagataattccctttcaaaacttgaaattgatttacgtaattttgatatttcatcatttttaggttgatttgataaatcgactattttttcctctaaagaattaacttttaagcctaacatttgattttctctgcttacttcaccaaacttcaaaattaattcattagcaaaagccattttttcaataagtttatctccatttttcacatgattataaacttcttcctttgactttttctcaataagcatttcatcacggatatatttagtatcttctttaacatatgagtttttttgaactaattcttgtttattcttttcaatattgtttgataaattgctttgtatcagaacatatttatcatattgatttgtcgaaattttggaaaattcgtctaccaatttctcttgaccttcttctaaaagctcaagttctcgttgaatagctttattatccctagagtttgaaatcaaaactcccacatttgtaaaaataattcctacaacaccacctaaagtagcccaatccattactgaataatcccctatcattttttctcctattctatcacattttattccaatctgtattatttaattaaaaaagccatgaaattaatcatggcattatcttatttttcacttttctttttgaaaaaggttaaatacttttttatattatctttaaaaccaatccaaactgctccagcaattaacaagagacctactattgtaaagatagtcttaccctcaccagtttttggcaatacttctatttttccatctgattttttaattgctacagtaccgtctttttgaacatttccaccaacttcagcagcatcttttaattgcgtacctgatggtgtctgtactaaaactttaccatcttgagtaccaatgacttgatctcctgttacagttgtaataggttgattaatagttggctttgttactggttttatagatgattctgaatgatcactaggtttattcgtagaaggtttgtcaataccggcatttggtttagtaccattatcagtaattccatctactggatttgttgtacttgatgatggagtacttgaatctgtcgtacctgttgtttgatctgtacttggtgttggtgcacttggttctgtggtatctgttattggatctgtacttggtgttggcgcacttggttctgtggtatctgttattggatctgtacttggtgttggcgcacttggttctgtggtatctgttactggatttatacttgatggtggtggcattatagaatcagatacacctgcatctacccctgatagcattatagtatcacctccactaattacaacatctgcacttgctgataaattaccagccattaaaaatagtcctgaaacagtaattaaacttaaaacttttacttttgacataaattttccttctttcttaaaatactacatttacaggtgtaccatgtacactcgcaatctcaaattggtctgtacctaatacataattaccagctaaacttaatttgtctcttttatctgttactaaattaatagtaaactgataaacattactcgcatctgactcatatacttgtaaactttccaaatcaaaatgataaccagccatcaacatggtttttacagtttgggcaactgtaggatttgtaatggataatttattttgataatcacccttaatatctgattgtgttgggatttttacaaggtaatcaataggtacagttatagatcttttaaccttctccttttccttatcagatacttgacgatcactagcttccaaagtagattttgcttctttagttgaatcataagacttaaccttatgtttcggttcaactcgttcaacttttgtatgattaccacttgttttaatcactggattatctttttgaataactttataaactataaaagccatcactaacaccattaaaaataaaactatttttctacgtttcattaactacctaccgttttcactttatcagacaatttataaccagctttagagggattataaaaactataatgctctttttttaattctaaagtagaaacataacgataattccatgaatatggtccaaatcctctattatctccagaataagttgaataattttgctctactattaacatatcgccattttcaaatacatgactaaccactccagtatgcccagcactagaagtacctgaacttgaaaaaacagctccagaagatggagtattttcagagcgtccaccgaatgcagatacccaattagaaacaaccatattaccatttcccattctttgcgttggatgcattccgcctttaagccataaaccatacatcaaacttgctgaaagatctgtacattgaccaccagtagaagctatcgcattccatccactagacgttcgataaaataaaccaactgacttaggatctattgcatactttttcaaatcacttggtaattgatctggtttccatgcattataagaagtgtatttaactttccctgacttatctttaccaaataagccctgtaccgcattactagctgaatcacaaagagataaaactgtagaatcagaaattatatcgctcttaccagacgaggacgtttttgaaccaccaccaaaacttttagaaaatttttctgcatcaaatttatattttgaaccattaaatatttcataggctttttgcccatccgcagtcttttgagctttattaatatatgcagtatttcctcgttcgtaagcattccaaactaaagtggcctgcttgggatcagtcatctgtgccatctcttcaaaagaatgatttccacctgataaatccattgctttattccagtctcctgatttaatggatttcataacaaaggcattcatggcatctgcatcttcccatttgggatcgcctaatggggcatactttgtgaaaggtgtgatttgataaataccacctccagcttcagtcgtatagtaagataacccagtaggtctcacattaaaggcaattgaatttgtttttaaatcattaccataatgcccttctgctcgacctatcatagcaaatccaccttctgaattaacccaaccaacaatccctgatgcactcgcaccagataagcctttacttacccaagcattgaataccttctctgctgtttgatttgcaactgttcccttttttgtccaatcactattggaagcattctcacttgaggtttcaacttgtgaagatacatctggtgtaatttgacaatcttgttgagaacttgacgaagcagtcaacaataaaaccaataaaaaaggaaatacaatcagtattcccaaacagcctaattttttcttatgttttactttagttccctcctttcaaacaaaataaaaaagctccaacaaaaattgatactttaaaccactatgaaatatgatataataatgaagcagaaaagttaagacggtggctcttatttctgaaaggtaggtggtcccatgggcaattcatcaaaatccaacagaaaggaggagctagatttgtctacctttgaggtcttaacactcatgtttatagcaggtaacttcgttatcgctctcgtgaagttagtccttgaactggtaaaatcgacaaaaaaataaccgtctcaactttggcgagttaacggttattttttaacggttattttctgccaccgtcttaaacggttctgctaagcagttgttagaagcaactgctttttatttacaattatattatacataatctaaaaaatagtgtcaattaatatatagtttactaaacctctcaatgtcataaaactccttgtactacttaccttctctcagcttttctagttcttccaaaacttttgactgtcgttcaagattatgttgctttctaacttccttagttttactggcattaaatcccttttcaaaagcatttttaccatgattttttgtcatggatacatcactattaaattgacttaattcaccctctagcttattaagctttcgctgttttaatggtgaagtatagttatttgaatgattttctatatcatttgttatcatatcctgatttgttaatgaagtatctccatctccttcttgaaacgtgtgattatccgacttaacattttttaaaatttcctctgttgaattaccttctgatataaacgatagctcataagaagattcctttcccaattgttcaatccttttacttgcttctttaggtaactctgattgatattcaccttcattagtcagctcagcctctttagaaataacagtatcatccgcattagcttcatcatacttatcagcatcattagttttagactgaccatcatctaaattagcttgttgtctttctttgaaagcattccaattatcttgtgcattcatcattgtaccaacaccatagccagctcccatcatggcaaggcttgacatatcgtgtgccctctcataaatggattttggcgtaattcctagattttctgctttttcattaattttatctacagactgattaatgacttgagaagctctagaccctataatcagtcttaagaaagtttctttatatttccaaattccccaaaacacacaaccttggacgaaaactgttattagcaacataaacagtattgcctgacctttaaaattactaccactaagcagggaaccatctgtaaattttttcttaacaaaggtggctattaaagtttgagtatagaagactatcaaggttaaaaaaccagctaaggcaggaaaggaaacagccccaaacatgactttcaaaacattgaaaatgatatcttgcattctaggcaaaaatgaaactaataaagctaatggaaaaataaacattaatataatcactaaaacatctgccataaaagcaattaactgaatgagtattaatggaactgcgagtataaccgcttcaaaaatctttaagataacatagcctgattttatccaaagataatcatttactgcagaaagccatctatttttttcctccccttcggttgccttatctcccaaattatcagtataattcaatatatccttttgttttggagtgataaatttacctgatttatcgtacttacctaaaacttgttcgttatcaaacttttcttctttacctgtttgattattgtgaaacttaccatttaactgaccagtattgacaaacaaataagccgtataagaagttttcatcacataattatcagctactgatgatttttgtgtgatctttgttttaccacctgatggattatccagtgataaattagttaccgcatctgaaaacgaaccagctagttgatgaacggtatctaaaatataaataccacctgatgttgattgaatcgtaccaaagtaacccatacctaaaatgataaccacgaacaagtggatcaaacgtttagaaaaatctccttttgaaaaaagatatgaaataaatattgaaaaagctgaaatcgcaaccaataaataaagcaaggagcttgtataagacccattacctgatagattttcccataatttttgagacgaatgataaactgtttgtttataggtatcatacaaactgaaattttcaaaaaagcgtagaataacagaaaataaaccaacaatcaagttaagtaggaaaaagggaaaattaacaaaaacatctaacaaaatgctttgagctccagtctcagctccgtgagttatctccatataagcctttaacgcaaatatatccacatcttttaccttcgcaaaggtcgaagcaatcaaaccatcatctattttgtccatctgattacctcccttctacgaagcatatttattttcaaggtgacttgatactgttttcttcataggttttaacaatggatcaatatctggatgaatgttatgtatcgaaatcatattcaagttaccgtaaacatcataataaagacattgacctgaaatcatattatcaatccattctagattcttaggtgttacttctaaaccaacatgacttaaaatatcttcacgttccgatttttcataaaatgaaaaaattgtcccaaagccggtcgtatcatcatcgttttctgcatcatgaaccgattgagatactagcatcaacacattatacttagagcgaccaacacgacgcatagacttgataacagccttaccttctgaggattgcataagtacccatgcttcatcaaaaatttcaactgtttcatcatcactacgctcaccaaaatgcttacaaaacgcacctaaagcaaacattaaagcaatcgaattactttcatgatcagatatatgatctgaaccgtccttaggcaatgataaatccgcaacttctaaaactgtcacacgttcttcgtaagaaagaccagcaacatcaccatctgaaaatgccaactctaaaatagaattctgaataatagctttaaaataacgaccaactgactgaacttcatcactttcagaatcaataagaacttcaataacctgattaaaaccaacgacttcaccagcttcacgttttgcaatgacttgactaattgcttctgttaaagctgttgtttgatctaatttaatctctgtagcgttttttaacaaataaagcaacatatttttagccgttgaggaagcaccttccttatcaagaataacaataggatctaatacaccatgattttctttgacagaactatcaagagtgacaaaattcgtttcctcaatttgcttcttacgtagaggaaacttacgtgcatactctggatcagaaacaacttttaaatagtgttgccgtagttctcgtttagggtcaacataaaggacacgaacattttgttgagcagtatgtaaaaagatcatctgtgctaagtatgatttcccttgacctgtcgccccagttataatcacgtgaggatttttagtaaccttaccagcaacatcttctttattcgcgactgtcgcattaaataagacaagatttttagatcccataatagcttcgtcaatagaatcccaagcagttaaacgattatctactcgtccaatataccaaccaatcctgttacctgattgggtatttgtaaaaagcatcaactccgaaaaacctcgagcagttactaaatgattccacttacgagttgttttttgtaaatcttgaccataaagtaacgcttgaaataaatatggtgtatcatgactggcttcataaacattgactttcatatcatcaaagtaacttaaaatggcatatctacgttgttttagttgatttaaactagaaccagcaactaccaaataacaaccatactctatgatttcttccttatttccaacttttttcataagatccttaagcgaatatgctcccatcaagatatcatcttgttgaaccgtatttgtgttataagcttctttcatgatttgatcatagcgtgtatttgagcgacccatagtgccacccaattttgtcttatctataaattccgctttaaatcttaattcaaccggaaaactcattctttgaactagttcaccaagatgaaagccattaaatatggtagagaaccgacctactggaagaacggatacaaatgaactcccataagcactctccaattttaaaaaaccaccttctagtgatttaatcaacgtatctgtcacatttaacatattccgattagctataacctcacttttagtatggggaacatatcttaaaaattgcatccgttgataataaaataaatcaacatccgttaatcttttggctttcagggtagacaataaactatagacaagtaattcttcttctgaatgttctttataccaatcttcatctacttctacctcataaccagctaaagaagcgaagtttgatgcgatagattcaaactgattataaataaattcttttatattagcattgtattgccctttaccaagatcaactccaattaaccaatcaaactgatacggtatctccatttcatgtgttaacgtatcaactgtaaaatcgagtgtttctaaccctaattctttaacatcatctgctagatccgcttcaaaatccgacattttttcaccaagaagataatcttttggtattagacttcctgcgaaactaaaatcctagttcacggttgatcattccagcaatcaaattcattcgtaatccaaaccgtttgcgtcgatttcgataggttgttgaaaatattttaaacgtttttactttggcaaaaatattctcaaccttgattctctctttggatagcgtatggttataggttttatcttcaagagttagtggcttaagtttgcttgatttcctcggagtttgcgcttgtgaatacatcttcatgatcccttgataaccactgtctgccaagattttagcagcttgtccgatgtttctgcgactcattttgaacaacttcatatcgtggcaatagttcactgcaatatccaaagaaacaattctcccttggcttgtgacaatcgcctgagccttcatagcatgacatttctttttaccagaataattcgctagttgatttttttaggacgattgatttttacctctgttgcatccacaatcaccgtatcctcagcactaagatgagtttttgaaatcgtaaaaccactttgaataagagttgattcaacccattgacttcgacggattaagttgctttcgtgaatgccaaaatcagccgcaatttgttcataagtgcggtattctcgcatgtattgaagagtagccatgaggagatcttctaagcttaacttaggggttcggccaccttttgcgtgtttacgttgataagctgtttttaacacagctaacatctcttcaaaagtagtgcgctgaacaccaacaaggcgcttaaatcgtacatcagttaattgtttgcttgcttcataattcatagaactattgtaccatattttgtttcgcaggaagtctattaatgaaatatcaaaatttttatatttagctaattttttgataacctgtgctactttcgttttgtgactatctttcttatcactatctgtaatagtgattggggtatttggaatacgatagtatgcgacaacaactttatcttttcgtaaagctaaattctgatgtattctatcaatcggatattccaatttttttaccatctgatctcctttcttagtctttatattttcgttttctcaaaaactatttcttcttcaatatcaacacgttctccttgatagataccttttttatttaacccaaaatctttgagataaaccagataatcccacaaaaagatatgcatcttttttccttgcggttcatattctacataaaatttcgctaacttgcttggaacaaaccaatacaagagcattgaaacggaatgcgttaaagcatttaacacctgcattaatggagaacataccgtcagcatcaacattaagatgataaagaaaacaataaaaaatgataactgcataggtgtagaaaaataccaaatcactttgccttttgccgttttaacttcctgaatccagtaaggagcattcaagcccctgctgtaatcaaaatatttttcttcttccataacttataacttataaccccgtctcaacaccaaaccagcgaagcattccacccaaaaaagatagaatctgttgacctttaagcattgatacaataatcgcataaatagctaaggttgagaaaacttttaaccaattagcttctttccaattcttaataattataaagacagcaattacactaatgaggtaaatcccatcaccttgaaaaaattgctttagtcctgaaacgttgggaccacctgctaaaataacactattcacttttactaaattcattttttccctctcttacacctctatttaaaataatgatacatctcttcaacataccaaccattgtctgctttaaataaatataatgtaaagttttctgatcgtgtgccacctgttacaagatcttcaaaagttactgataattgcacgacttgatgctttttttcttgataataaatcgcattattaagatctagctcactaactttaaatcctttccccatcagttctggagttttcattaacagtttcaagtctgtcttgttaattaaggcatatttattaaagaaaactggtaaaaacttttgaatagaacttacttgttctttcgatagttccttgacttgatctaatgttttcttctcaaatgctttagatttacctaaatacaaatcttctgccacagtataaggttgactaacgattgcaagcaatcctctttgcatctgaaaaggaacagccaagttcatctgatatgattttttatcaacttcataaccaatacgcatcaaagctatatagtaatctttttctttttcaacacttattaaacgttgtgtctgcaaagtcctagactttctaacatcatctgtcatactggcagttgagaaagaataataattttctaattctgtttttctttgatctgcagtatcttgtgaatagttgatatagtagtagacaaaattattcatgtaatactgaattctagatatatctaatgaatcatcagtcttcttatgttttgactttttttctacagcaataactgtttcttttaaatgttgtacctgattagataagccaattgccctcaatgatccaaaaaatcctacaataaataacaaacctaagataccatagacaataaaattggctgtcctttgctttacttcttttgtcttaggctgtttacctccctcttctttctttgtatatctcaatagaaacttttttattttttgtatatcaatcatttaacccctttctataaaataaaaaagcagtcactttttttagcgactacttctacttataatgatctctaaaagataaaaaatagatttctccatcttctatcatataaatcaacctatgttcttctgtaattcttcgagaccaagcccctgaataatggtattttaaaggttctggttttccaatgccttcaaatgggtctcttttaatatcttctatcaaacgattaattcgtttcaagatttttttatcttcctgttgccaagaaacataatctttccatgcttcttcagtaaaattaaacatcttctacctcaattaaaccatgtttagtgacttgcttctctttaacttgtgatataccattaataaccttatgtgatagataatcattttccatcaaacgaatcgtttcttgtaaactttcccagctatcttgagataaaaccactatattttcatcaggatttttattaactacaatcaaaggctcaaattcatcattgaccttcttcatataatcttttaaattatttctaaaatgtgaataaacaatagcctccatattaatcacctcaactttactagatatgttgttattatatcatttgacaacatgttgtacaagttttggttttgataatcactaaataaataacttacaaatgataacaatacataaattatcgttaagcttccaattacctcctcattctgtttttaacacgtaaaaaccttttgaggtgtttaatactattccttcttcaatataagcatttaaagcatttacccaagttactgaccgttgccaaaaatcaattaaagaatcaaattcaactttccttaagatatatttcattactttattttcattatttgacaaaaatatataatattttgtcactattgaatgaactgataaaccttttttcaaaagatattgaacaatatagtcatcaccatcataaagtccttcaatacatctttttaaaagatagacttctgtaagtgacataatcctatcaacattccaatcagaaaaaccacaaataaaaaaggcatcatccttaatgcctttttctatcatacggtttcttacttgattttccgtaaactgcatgatgtctaactcacataaaaattgacttctacctttttcacgagtccttataattgcaatcattatctacttaccctgatatttcgacatatccgtagtctgaaaaaccaccttggctttctaagtcaatatctcgaccataagcttcatgatcaaaatacatctccagagcctctttaccaactccttgtacgcctaattcatcgaaataatattcacctagttctcgtctagttgtgacatcagacagtaaacaacaatcaccaaaattaaaatcataatccacaaagtctgaggcagtataacctattacctgatgcactgctttaacaagttcactatcaacattctctaccagttcaacaaattgattaatcatctcaatagaatcatgttcttttagtaactgacaatccgaatctgcaataatatactctaaatcatcttcttcacgaagccccaaagctaacttaagctcactcatttccacaggaaaacaaactaacgtagctctaccagtttttatatctctaacaattgcactaacatccatttttgacactccttaattaaaaaaggagcaagccattgacttgctctcacccttaatgaaattcttgtagtttatgaccaatcgctgacatagacttatgagccttattaatcatattattttggtagtagtatgatttcaaatgttgttgaatcatgtcgaccatataacctggtaaagtcaattcttcacgctttttaagtaagctatttaactctccagctttttcccatgactgttcatactgatggctgaccaacagctctgaaagctcctgagtaaccactaacaactttttatctgcttctgaacgtgttcctgacattttattttcctcttttttctttagactctaacaataaatcaacctattacagttggacatctaattttcataattttcacccacaaaaaaagaactcctataaagaagttctaattactcatatataaattacattacgaggattcaatacagaaagttaaaaattcatctaaattactcttatttgaagaaattaacttatctcttagctcttttatcgtctccacatcctgctcccctcgttctacaggaaacagctttttgtagtgtctcttttctttatcattcttagcataccaataaccaatatcattaaggacctcctcgaaattgctatcattccatataggaacaataaaatcttttttccaatcttttacaaataatgtagaactcttataggaatctatcttttcctgcgatgtatcatcaatatccatgataataaagattttaacgtttttgggatttccttttttatcgcactcaaccttgaaaaatttttctttaaaacattttttagttttaaaatctctattttttaaaatatcattaatcgaagatatttgtatagatgttttcccatttgacctcgagtatatttcaagaggaagcctcagttttgatttaatatgtttaacaaaatccagttcacttttaccgtgaacaattactatggcttttgtgtatttacgaaaactcatttttagtcctcgcttaaattatgatcaagaaataaatctgaaaaatcaatatctaatggatctggtacagcaccaaagaaaccagacaaatataatttttctaaattgttatttactcctatttttttatctgcctcattgccagaaatgataactttattacctttaatatctacatttaaaaaataagctgagctcggtgataattccttcaataacgttgtatcatgcgttgtaaatattaactgaccattcacacttcctttcaagtcattcagaatactattcattaaaagatcatgaatacctgagtcaatttcatcaacgatacatattttcccatccaacacattgttaaaaacttttagaagatccagaagattttttgttccctgagattctaaacttattggtacatctaaaagatcacctccaatattttttcggatcatgagttcatattttatttcttgaccttgagcatcctgcttatatttaacatcttttatatcaatatataatgcactaaaatatttataaataatttcctcagtataggaaagtttttctttttccgacttatcaattttaccttttgaaatatctttcaataataattctgtcgaatgaaaaggacctctaaaattaccactccaaataaaaattttatcaaattcatcaactactttttgaaaatttatagaaacttgttcattaataaactcttcatttacttctagacaataattattaaatattgataggaatgtatgtttaccccaatatttttctatttgttcagtcaaatctttaaaaatagtattcttaaaaattgtcttatttaatgattgagataaaccatctatgttagtaatactgaaatgaactcccttattggattttatcttaaatactagctcctcttttactagttcattattttcattatattctagaaggtaataaccattatctttttcgatattaaaataatattttagaatcgtattaccttcagatgcaattctatgagtatttttcgctatgcccttaaaagtggtgaagaaactgattttatctaagatttctgatatatcaccaaagttagttttttgattttcttctttatttgtttgttcttttaataatgattgtaatcgtgtattttcatttaaggattccattgattgtaatgacaaaactagtaacttaaaagcttcaacaatatttgtttttcctgaaccgttttctccatagattgcaataatatccttacattttcctctattcagcaaatcaaaagtcaaatttgaaaaggacataaagtttttaaattctattttactaaacatatgcatccctcgtttctattacgattttttgtttttaacatatgtacaatacaaattgtacaccactttactaaaaaacacaagataaattatccttttataaattaatatatataacctcttttgattattctgaagtcatccaaaccttcctcaaattagtcagtttcatattctcgaaataattcccttttcatcaatattctttttctaaccttaactctttcagtcttttagaaaaacttttcatattgttttttgaaagcacaatagtattactaaaattatcacttctaccaagtaaataatctacagtaacatctaggatatttgctaactttattatattatctaaagtaggttcagctttaccactttcccaattactatatgacttttgacttatatttaatttagacgctagctcagtttgagttagttttttttctttacgcaattcttttagtttttgtggaaaattagtcaacttcttcatctctaaacatttcccttctcatcagaattcttttttccaaacgatatttaccagctaaacgaataactatctctttttgcttttctaaaggttgcataagcaaaccaaactttaaaagtttccgtttaaaatcagcaagttcccttaacttatcttcgtagtctttttgaatttcataaacaccaacataaccaatcttaatcaaatcataaatgtctatctgataatctctaagctcacctgtttgaatctcaggataataaaactcacgatcaggaatcataaaaactagtaaatcaatcattttatctaaattatttcgtctattaacacaataagcaaattctcggttactatacaaaacaaaacttacctcctacaaaatacctaagctagctttgatactgtcaagtatcttctccccacgttcattgacttccccagaattaagaatggtttgtaaatagtcaccatccacaatcatgtcatactctcttatcatagctaaagacggagaaacagaatcacttaaccaacgtaaggttcgttcaatactataagcctctggctttgtaacaaattttaaaggctcaacacctccaaacattaattgccactttctatctgcttgaaacgacccatattcatttttcccatcatacacgtcaatcttactaacaattaaccctctggatatttcaccaatcggcactccagaaataaattcatcaactgccgcattagctttactttgagataaccgtatctcataacgattccacaattcaaaaatttctaaagcttcttcaacagtaattccttcctgctttgcaatttcataacgtttttcataaaagttaaaatacatttctgattgacgactaccaaaataaagcgatattccttgtctattctgctcaatctcttccatatccgaaaaatttaaagaaccgccacctatataattccaagttctcaaactttcaaaatctaactcatgacgataatattttgaaatcatatctgacaaatgaaactgttcattttctctatccttacccagatacaattcatcaatagcaatatcaaaacgtgtcacattcatatcatcacgatatgaatttcttagataacttaaccaatcatgccatgtaaatttttcagtttccatcaacaattccaattgtcggcatccacgaccagacaattgaacagttatttgaaaattacctgtctcatgtttatccgcaaaatcaaatatccaaatatctccacgtttccaaagatgattgtaattcatcaacttcgattcaaaaggctgaaattctttaaatgcacagtgcaaaaagttacgacagaaaaattcaagatccctaacatcctttaacgtaattctgacatagtcaatcatcacttgtaatcgtgaactatcattttctactagatatccaaaatgtgattttatctcttgatacttttcaagtgtcaacttccgctttccttgctcatagtttctaagtgatttcaatgtcaaaccagaacttaaagcaaattccttttgttttagacctgttttctttcgaaatttttttaaatagatagcatccacaataaacaaactccttcttaggattagtgacccacttttttcactaaaatgacccacctttaaaaatctgaaaacccttgatacatataggtttttgggggttaaaattcgaaatttttcatttcttacccccctattagaaaacgggggttttaaaattgataaatccctctgtaaagccctagtgtgtgcgctgtgtccggcgtgtccgttttcgctacgctacactacgcctacagctacactagggctttacagaaggatatttaaaaaatacccttcatctactattcacccttaaaataattcaatagtaactctttccagctaccctcaaattcatctttttgtgtcagtaaactttctaagacgactgcatcagaatcatttaatacaaccttttcatcttcacgactaaaagtcatataattatctttttcaatcatatctattaaattcttaatcttaccaaatgaaaaacctgttttcttagctaaatcaccaatactcatattttccatttcctccatttcatcatcaaaatcaaaccctactgaacccttaagtaactcattttcagacgttttttccacaaactctctcaaagattcgtctttaagaatcgccttagaaacttcctgattttctgtaggatcaaaaggattctcatgcctatttattttttcaaaagcatcataaaaagagaaatttttaggtaataaaggagaataaaattctcttgctacttcaccaaaaacagctgaataacctcgaccataaacacgacgacctgcaagatatttaataaacctaaattccttatttctattttcatcaccaaacatcatcacataaccaccatcatcgagacgaccaaccgagatatggtgcatcatattagatctaattttagtgggaagatcatctgcagacggcttttgcattgctataatcgcattacatccaacctgacgtcctaacaatatatattgagtaaatgcattatctacaatctcacgttcctgataagacaaagaactcattaaagcattatattcatcacatacaaaaaaataaggttccaatccataatcataaaactttttcatgtctttatgacctaaacgcttcatttcatttcgaacaaaatcataacgtgcaaacattatcgtaacagcattttcaaacttctcaataatatcagccttttcaaaggcaattctaccttcaaaagctgataaatctgacatagtaacaaaatcggctcttttagggtcacatatatcacaaactccaatttccgcaagacaacgaaggattgaccttagtaatactgttttacctccaccagtaccaccagcaactaataaatgaggatcattgatgaaatcccaataatagccatccattaacttaattcccttatctttattccatatcacatctttaaccgtaatacgtgataagaaagccgaataagctaatttgtaaattttaaagcgtggatcatcagttttttccataaaatccatgaaaaaagtatcttctaattctccaccaatatccttaaatttcttttgaaattttcctccagccatttcaaatgaaacacttaaatcatacttaccttgtttcacataaacttttggaaaacgatattttgtcttcgttttcttatttgattttttacgtttttcataaacatagccattctcatataaaaacttagacattctttttaatcgatctagtttattaaataatggattagcttcttgcaaaaaccaagtcaaataccaagaaacaaaaaatgctaaaaacaaacctgtacctacactgatcatagacattttatccatcatttttaacaaatctaaatagtaataactatacacgcctacaggtgtcaaaaacaaaataaatagaaaagaaaaaaggtaataactcatatacctcatatatggttttaccttaatccctctatattgtggtattaaacgagccaaattacccctcctttaccgtttatttattaactttagatgcttcattttttgatgcgtttccattatttgcaacatcctttttcttaagtgatgatgcaaaaattttaaacataccacctgaaacgttagaccatgtcacaacaacatcacttaattcaatagggtcacccaatttaagacctaaatcctcgattgcataagaaggcatatcagtaattgaaacaaaaattgtttcattttgagcagtactaaatactgcaatatcattccacttcacttcacctgttggtttttgtggataacgaccaaatcgatctggtggttgtgtcgtatcatcttccgtaaattgaactggttcttcatatcgtctccaagttaaatctcctaacaaaacatttacatccaatccatcattaaaggtacgatattccttatctgcaatttgtaatttttctccaaagtttaaaccaatttttgccatatttctaatcctctactttccttatttcacttcaataagcttttcagcccatacattttttgcaggttcaatatttctaccattaattgtattgtcaataaacaataacggtttttcaacagttaccatttttccatttccaatcacacgtgaagatgctggtgtataaacataaaacttaccatgtttttcattaaacaaaatgtgtcttgtataagacccttttttaccatttaattgagcaggtccagcttcaaatccttcataaattgcatctccaataaaatttggaagtaacactaatgtttcttgtttcataatttcctcttttctaaaaataagaagcactttttcaagtgcttctgaatattgactttttaattttctttgcgttttttaaatcctgctaaaccgatagctgacaagatgattgctccaagtgctgtaagaggggcaacgcttgcttcaccagtttgaggtaatcctttagcaggagcttttggagttgctttttgtggttcaactggttttggtttctcaggagtatgtgttaccacagtttcagttttaaccttattcccattgataaaaaagtctgcggtattgtaaacatcacctgctttgatacgtttaaccaccacaaaatcatctgccccaaattcactagaacgtgcaactttttcaaggaagtctttcttgaagactaattcatagagacctgtctttttgttgtaaactgtttctgtgtactctcctaaattagtcccttttttaatgactgtaccatcttttaatgtcacatcaactttagcgaccactttatcacgtaagtaaagatcaggtgtgcgttgtaattgatccacaaatttgtattcaaatagatcataagaacgacctgttggaactacccaaccctctaatttgtaagtaacttcatcacctaatttgacagtaccattgttgatagacttgccatcttctttgtctaacacatctttatgtatttctggagttgtcaaatcattgactacaatattacctgtatatccattgccaaagtcgatttgtgcaacaccattttgaatttgacctttagtaaactcttttttaactttaaatgataagttataagtaacatctagacctttttgaacataagctttataaaaagcttgtggatcttttgcagtccacatgtaaaactcaccaacaggactgattcctgcttctttaataagcgtttgaagtttctcatctaaagtatccgtagaaagcacatgtcgcatttctaagagttgtgacacatctgtgccatcagatgctttgattgagttcactttcatagacttaccatctagtgcgtcatctttataatcatcaataaagacaaagtttttagctattttaccttgtgatgcagtcattcctttatattggctaaagtcttgtttagcaacgtaatttaattcagcatttggtaatacggttttaccattaacagattgacctgcttcatcaatgacagcttttgaaggattagcagctggaactaaaacaggatgaacactaactgagtagttaatcttttcaggaatagacacatgtggtttcacttttggttgagctggagtgtaagtttttaatgtaggtgttacaaatttaggctcaactggtttttcaggtactggtttttctgcttcaggagtcactttttctgttgacggtggtgttggctgttttggtataacaacgttaggaacaacatcattattattaacataagacactaaagcagacccatgtgtgtcatgtacccagtcatcatgaatcttaaagacttcaacgcttccactagaaccatgtggtttaagctcatatttaagattgagttgtaaagttttgtttaaagtttctgcaaaagttttgttaccattatgtttcttctcaaaaatgatttgtccgtctttagttaagactctgaaagcaatattttgattaacagcagcattttgagcaacattacgatactcgtacttgtaaagagtgatagagtcaacaaatgctgtcacagagccatctttgttagcaacataatgatgattaactttacctgtcaatttcccatagccgattgtcttcacaccatcgatcatatcatggttaaactcgaaacttccgtcaggtttagtttttgcagtcatgattgagtttccatattcagcgttatcaacacctttagcttgagctttgatatcaaaagcaacattattaatagactgtttatctgcttctgctttagcttttagagcttgattataaagtgctaatttagcttgatagtctttttgtaactgtgcgttagtcgcatctgctttagcttgtgcatctttattacgttgacgtacacctgcattataagcttcaactgatttgattttcgctaatttagcttgataatctttttgtaattgtgcattagtcgcatctgctttagcttgtgcatctttgttttcagcatcaatttttgctttagtttgtgcatttaactgacttacacgttgagactctgctttgttttctgcgtcaatttttgcattttcagcagtagcatctttaatagcttgtgtattagcttgtgcttttgcagtaacatctttaactgtttgtgtttgattagctaaatcagcttgtgcatcagtagttgtcgcatgattaactgcagctgtggttgtaacagctacagctgcttttttagctgtagctactgctttatcaagttgagttgatgttactgtttctgcttgattttgcgttactgtttgagttgttgcttgagttgtaacttgatcagcagacacttgactagtctgtaatgtcgtgatcattcacttcataccaattgaaagtatcgtataacatagctttattgaaagcacttgaattaaatcgtggcttacgctttttatggagcttctcattgaaaaggattttggctcgtaaggcatcaaacgagtaacctctacccattcgctctacctgcctaataatgctgttaattgactccgtataagcattagtgagccttttatcaaagtagttgaatatttcaacatgccagttgtctacggctctcacgaggtctttatatgcgtctttagagttgctggacatacaacggtgtctccattgactataacgaagatgaccttcatctggatcaggagtatcccatatccagtaaaactcttctttgagttcataggcttcttttaaagcaggaagattacctaaccaagtatctaagaggaatgattcacgttcatttagatcgtgtttacgctttagaaggataaacctttcacgcataagggtacgtctttctttttggctcatatgggctttcaaagactttctgacgttatctaaggcttgattagccattctaactacatgaaacttatctacgacaactttagcttgtggaaggatagtgttcactgcgtctttgtagggcttccacatatccattgtgacgtactcaatgtaagtcctgtcactgatttctgaaagacgttggatgactgtttccttgttacggttaggcttgatgtcataaatagtcctgcgttcaatattagtcaatacaagccgaggtctacggataatatgtatctcgtctatcccaagccacttaggagtttcaaactggtattcacgttctttgagtgccacatagtccttaaaaacgttcctaatggttttctcgtcaacaccaacgctttctgcgacttctacaaaggtcttagacatggattgctcttgaatggactttaaaagccttttggtcatactacgcttttcatctacagatatggtagatccgcattcacgacacttgtatcgtctacggttcaaatgtaagcccactcgctttaaacgaatgggcaaatccataattagttgatttcttgaactgtgtttgtacaacttgtcaaaaccacattcaggacaacgttcaggtggtccgactgcttcaactttaaacatcatatcggtttcattttcttgtggcggttctattgttttaatgtctggtagggataataagtctgacatattattcatcctttattactctgcggtgttaaggtatcaattatagatttgatgtcgaaatcatcagtgttaaattatttttgtgaccacaaatgcacttagaaaatcccttaaagcattagctggttcacttgaatagggagttgtaaaaaagttcccttagcctgcacaacaagataatttcgaaatatctttatcgaacgtaagtgcaactaattttagcccttcagccattgttaaatatggtgctagggtttctgttaaatcttctatcgttaagccaaatttaacagctaatgatgctgcatagatgacatctcctgcattttcagatacaatatgaacccctaatacttttagtgtttctgcatctgctactagtttaaatacaccggttgtttcacggtttacaattgctcttggaacagcacctaaaggtaatacagatgtcttcacatcataccctttctcttttgcttgttcttctgttaaaccaaccgttgcaaccgtcggattcgtaaacgtaacagcaggaactaccgataaatctatttttttgtttaatccaccaatagcattatcagtaataattccaccttcataggctgctacatatacaaattgtggtcctaaagtcacatctcctgctgcataaatcttttcattacttgtttgaccaaaatcattgatcaggatttcattattttttccagtttcaacacctgctgcacttaaatttaaagaatccgtatttggttttcttccagtggcaacaagtaactgatctgattcaatgacttctctactgccatttactgttacgtaaaccctttttatctctccactttgttcaacacgctcaaaagttgcccctttgacaaggtttataccctgttcaattaacgctttttcaactgactctgaaatctcaggatcatactcctttaaaagtcgctcacttctttgcataagcgttatttctgaacctaaatgatgaaatagttgtccaagctccattccaatgtatcctgaaccaattacagttaatcgttttggtattttctttaactcaagaagtgttgtactagttaaatagtccattttttcaagtcctgaaatttggggcaacgaaggcgatgcacctgttgcaattaaaaagcgttttgcagataactttgtcccattgacctcaaccgtactagcatcaacgaattttgcttcacctttaattaaatcaaaattatattcatcaattaaatccatatatttttgattccgaagttcgctcaccaatttatccttttgcgtgattaaactagctaaatccacttctccagcggatgtttgtaaacctataaacggattgtcttttgataaatgattgatttcccctgccctaagaagagtttttgacggaacacagccaatattcacacaggttcccccaaccgttccacgctcaatcattccaacttttgcaccgtattctatagctttaattgccgaagaaaaggcagcagcaccagaaccaataataagaaggtcataattgtcttcattaattaacgccacgttttctagtgatgatacttcttcaatttctccggcttggtaatttgcttcatcaatcgcctttattgcactttcaacctcaatatcatcgggcagttcaaatactgcttcaccacgacgataactagactcaatatttttagcacctatcttttcaagtgctgattctacgtgtttttcacaacccgtacaagtcattcctgaaatgtttaccttaaatttattcataaaaaagctcctttcgttaattaatctctcatgttaatgtttctattattggacacgaatgtaatttcttttcatctggacatcgttgttttaagtcgtctaacatagtttcaattcgttttaaatcctctatttgtttttgcacttccttttgttttttagaaacaaattcgaacatatcttgacaacgaacttcatctttatctacaacaccaagtaatttataaatctcgcttaaagagaaaccaagttcctgtattcgtttaataaacccaacacgcttaacgtcatcatatgaatatatccgataaccagcttccgttcggtgaggttcttgtaataaattttttcgctcgtaatatctgatcgtttctttattaactccacatttatctgcaaactcactaatgcgataaatcatcttatttcaccccctgaatattataaaccatgtaccatagtacacggtcaagtaaattggactattttatttttttcccaaagtatcactcgtatgtgattgatacttttatataatactattgattatcctaacatcccaccagaaaatccgatttaaacaccagttgtttttaaactattaagaaagtaattccactatatattccgaagaccctttaaatttaagttaatctaaatatttctgaactttcatgctaatcaattaaatttcatacgtgtttcttatttaatcttacctcaacaaaataaattttattaaaatatataaaaagcagactatgttatattttccatatttaaagtgttaaaagcccaacagtataaatgtcgattcttctaaaaatataagtagttgttatcttttgatttcattatacctttactattctatttaaatttgttcggtttcagtcacaccataaaattaactttttaaataagattttatttcggtatcaacataaacactttatagcgatctgaaaaaagagtaagattctgattcccttaaacttttattcctgataagagaattctttatttttaaaattaaacattgaaaaatttttatcattgtactaaaattaggtgtggttaatatattatttaaccatactatttcaatggaaaggtttatagttcaatgaatctacaaaaaaatgataaaacaaatagttttatccattatgcaaacggtccttccctagaagaaataaatgggacaattgaagttcctaaagatttgagcttttttaaaactttactagcttattctggaccgggtgcacttgttgctgttggttatatggatcctggaaattggtccacttccataactggcggtcaaaattttcaatatttactaatttcaattatcttaatgtctagtttaattgctatgctacttcaatacatgtcagctaagctaggtattgttactcagatggatcttgctcaagctatccgagcaaggaccagtaaacagttgggaattgtcttatggattctcactgagcttgctataatggcaacagatattgctgaagttattggtggggctattgcactttatttactgtttcatattccacttgcgattgctgttttcattacagtatttgatgtattactcttattattgttgacaaaaataggatttcgaaaaattgaagctctagtagttgctttaatattggttattttcttagtttttgcatatcaagtggctctttctcatcctatatggacggatatttttaaaggtttagtacctacatctgaagctttctcaacctctcatacagtaaatggacaaacaccactttcaggtgccttaggcattattggggcaactgttatgccacataatctttatctacattcttcagttgttcaaagtcgaaaactagatcataataacaaaaaagatatcgctagagcaattaggttttcaacttttgattcaaatattcaattaacagtagccttttttgttaattcactattactcattatgggcgttgctgttttcaaaacaggaagtgttactgatccatcattctttggtctatttaaagcactatctaattctactattatgagtaattctattttagctcatatagcaagttcaggtattttatcacttttatttgcaatagctttattagcatctggacagaattcaactattactggaacattaacaggtcaaattattatggaaggatttattcatatgaaagttccaatttggttccgtcgtatcattactcgcctaatttctgttattcctgtaatgatttgtgtcttagtaactagtggtagaagtactgttgaagaacatatagctattaataacttaatgaataactctcaagtcttcttagcatttgcattaccattctcaatgttacctctactaatatttactaatagtaaagttgaaatggatgatgattttaaaaatacttggataattaagattcttggttggctttcagttataggattaatttatctcaatatgaagggattgccaaatcaaattgaaggtttttggggagataacccaactcatcaacaaattattcttgcgcatcaaatagctcatatcatcattattagtgtaatactaactttaatatggactattgttgaattgtataaaggaaataaaaaatacagtacgatgcaacaaagtgcaacttaatttagtaaactaggtagcctcaagtaaagataaaagtagtagaataattctactacttttattgatattattttttaagaagtcaattataacattgaaaagaactcaacataaggagttgctatctattttgataatattattgatatgtataaaaaatcttgttgtaacctaaaatatttagagatcattagatacagccttagtggctggtgctaactggactcagaatttattcttagagataaaaatgtatgtacatattcccatattctagataacttatactaaaaaatttttattctagaatataaaaattactttaatcttttttaaaacccaaaatgacaaatcccttgattttactagatatttttatttagaaattaaatttaaattactttaattactaatagggacatctaactcaacaaaaaaagccctagggatggggcttttagtgttccttgaagtggattcgttgcgattttaaatgaaatttttgataacctcaaattcctctttttaatgcaaagttatttataaaggctagcttatcataggaggttacattccatttaataaccatcttctatttgataagcacactatcaaaaaactaattacactaaggcatatcatataaggaacaattataaaaaagtcggttaaatcaatagtcatcggatgtgagaaaagtttccctattattttatagagagaatttgaagcatcaaaaatagcagatactttaaaaattcctccaattgccactaaaataatggatgtaatccaataaaaaatagtaactccaatagaaactagcatattagaaaacaggatactaatagttgagacgactagtagatactgtagaacaacgagtgaaaataagattgtagttgttaaaaaataaaatagtgaatatccccaaagcaatgaagctaatatattgcaaactattatagcaataaaaaattctgaaaataatactaacagtttagtataaaagtatttagttagatgataccctgaaaaatagtgatataaaatacatttgtcagagtaatctttattaaagaaatatacaatgacaaagccgaatattaaaaatccaaattgggtaaatactgtgtaggtactaaagtaaaattctcccaaagttaaatgtcttattttatctatccctactggtaaaatatatcctaatacataggtcaaagctacagtagatataatataaaataatgttctacctcttatagactttctaaactccaatcctaacattttttattctcctaaataccaactaatagcatcatctaatgtgtctactttacaaattttttgattatcaattagaaaatagtttccctttaaagacctgatattattgatatcatgtgaaatattaataataattttttcgggataatactgaatatagttttgcaaaaatacgtttatctcatcaacagactttttatctaaagcattagtaatttcatcaagtataataatatgcttgtctaaagacaacaaaactaataatttcaccttttgtttctgcccatcacttaattgctttaacttaaccgttttacttatttgattaatattcaataactgataaatttctttagaaagcttccacggaattgtcctttctaaatcgttaatggtaacatcactaggaagattagaataactcgaaataatcagcgtgtcttcataaatatcatttgaaaaataattccctctatttatgataaaatctttagctagttgagatttacctgatccattcctacctaaaagatgatttatttccccttcttcaaagtctaagttagtattctctaaaagtattctatttcctatttttaaggtgtaattattaataaacatagctactccaatttacttatttcagacagcaacctatccataaagattaaactctaattaatgggctgaaccagcaacccatctattttttgaatttcttacaaaataccataaatcgtttacattgtctaatttatttttcttagttagaacttttgcaaagctcatatcatttagaattggttttacttctctctgaatatttttatttcaatagtcaaattactttatataacaactaaaaatatatttaaaaataaatttttggagatttttttaattttgaaaatcaactaagattaatatattcatcttttatgtaatattcaaatacatttgagtactctaaaaaaggtatatcttgtatttcttcaataacttatttttgttctagatttgttctagaaaatttatctttctttattaatttttataaacaaaaagtgataaattccttgatattacttgttttctttttttatacattaactttaaatacatatagttactttgtaggggcattaaactacataagaaaaagcctttatttaaaggcttttttgcttgacagaagaggatttgtcccatcatttgtccccaaaattatttattatttttcttgaaaatctttatgaatggtaattgagtttagacaatcacagcctattatcctttacacaataatattagttgaaattttgatatgaatttgacaaaaagatattcataaatttcattgctgattggtattctccttggttcagattaagtttcctattaatagaaatatatttcgccatttgatttgtttcatccaataaaaatcgcaaattagcctcaatgtcttttaaagatttatttgaaaaaattttcaatagttgatctttatctgtaatatattgcaagatatccttgtcgagctttccaaaagataatgaatcaagctctttttctattaatattttttgttttagaagtttaataaaagcatttttaataggattagatatcataaactctgaataaataatatcatttcttgctatccccttgactacataagtactaacccaatatatttcattaagaattttgttgatttcatcttctgacaattgctttgtttcgtacagagaacttctttcaaaattataatcaagatatttattctttttatctaaaagtacttttgaaaaagcatcatctaaataatcctccaagaattctggtttaataagtcttaaatcaatcctcgtcagatcttgaaactgcattaagtaagcaaagcaattgtattccgtcttatttctaaactcatttggtttctgcattataagaatatcaccgaattttttatgataattagtgtcagaaataatatcttctataaaattagtaacaaaaacaatatcataatcttgaaaatcatctttcggtacatttgggttagcccgagatccattcaatagtacagcttcgattctcttatcttggtttgctatgtttaacaccaaattatatatttcttgctcatctctcataatggctacctcctacttcactttatattaccatgttttttctaatacctttatattacccttgtatttttctctaagcatgtaatcatagacttaaattagcatggacatacctttacgacctccaaggattcaattttaaatttttcttaacaactgattatgattccaaatattttcaaccgtttaatgttagtatgtcatcagttatcatcactctttttatgatagttaagatttttaaactatcatcttttgaaaaacatttcatcttgactatttctgttaataaatcagctccatgagcaaaggcatgtatccatccaagctcctcgtcaaagcctctaaaatcaggttcatctataagccaggagaatgcctgattcataatttttatctgatcttcttcagatatccaacttttattatttgagtcctccaataataaagctagtaatagagcagtaaaagatctgtttaacacagtattactgttgggtactcctaatccttgtaaaagaaatttatcccttaaaactctctgaaggacatttaatttctggctttgcatcagtttatgttctattactaatttaacccaagacccatatactatttcatctcgaactcttgggttccaatctcctatatgatgtaatcaaaaagataaaacatcctcatcaattggataattattttctatctttttgattacatcacttgcttccatgtttctccttgcatgactttatattttatattttccaaagtgtaacatttgagttttcgttttcactttaaaatgattatagtaactttaattttttacttggatactcacttttatatcagaaatttttagtacttattctttgactctaggaataaagcgaaggcctaccttgtaacctctattaggaaaaaattgaggcatactataaatatacgatagaactaaaattaccagagaatatagaaagtataaaaatctaaaatacttctgctttaatttataatttccttgggttttacagctcgtgtaatatagtatattccagaaattaaaaagtaaaacataggtaatattcttaataaggcaaatggtgtttcaaataagaatgctaaccaaaatattttcccttgcatttcccatagaccttgcgtcagataccaactttttggatcaaatatggtgatagaagttgttcttatcaagagaaagaaataaaataaagagaaaaacgcatgctcacaagtatatttataataactcatagccatcgctgattttgattcttgatcagaaaaaatctctgaactggtttcaggctttattttttgaaaataatgcagccctccccaacgactaccgctaatatgcttccatccactgtcctcaaataaagtgatatagttagcatagtcatctttcgacatgtattttttaaaatccatttttattgacatcttgtctttttctttatctctcttaaaataatagaaggctggaagaaatgagttaatgcctgtaaaagcatagccacttttttgaaccttatcgatccattcttcctctttttctgtggatttaaaaaataatttaaactttatcataactatctcccccaaaacccaactgattagcagtattaagtaactttcttaatcgattcgtttcaagttctactatttcttttcctgtctcagtaataatataaacttttcttcttctatcgtcacttgggatagactttatccatttttgtttaagtaaattttcaatggcaccgtacattgtccctgcggctattctaacatcaccgccactcatttcttcaactttttgcataatagcatagccatgtgcttcctcaaacaaagctaataagatataataggtagtttctgttaacggtaaatgtttattccttttcatcaattttctttctatacagttaaactttatatagttattctatacaatacaactatataagtcaactgtatatttaaacttattaaaaagaaaagaacagatagcctatccaattattcgtttggagttttttattttagtcgtaacttctcaaaagtactatagttttttataatctattgactatagtactgttgtttattcatctcatcctgatcttaatacctttaattatgacttcttatccaatctatacagttaaaatacctcctcataaacacaatagtttttaaaattaataatagagactagagttcatcactctggcctctattattttttattcaatttatatccattgatttatttcttatgatattacttgaataagctaccataaccaatgataacagtaatcctaaaaatttctttttctatattctacaaccacttttccaatgtattatctaaaataatcgttatttgggtttattcatctgtttgactagtttttttcacaattaatcaagaagttttacatatatccttgaatctctatctggaaaaatgtagtctacatctagttcatctcttgttatttgcttaaatccttgattttcataaaagaagtgagatcttttctctttttctggagtatccaagacaattcttgtgaatttactagctcgagcaaaaagcataaatctttcaaataattttcgaccaagtcgaacaggatttcctctatattttggatatgtaaaaaatttttttagaacagctgttttatcatcaatacgcagtaacgcaatcgaaccaactactttttcattttctaaggcaatccaaaattgaccttttctgttttgataataattttctatttgaaaaatatcgtcttgttcagccatctttatatcaagtttagcttctatattctgacaataattaattaaatctactagctgtgctaaatggtacggattattctcgtattctttaatttccataatatatttccttattttgactttaaagtatatttctgcaatgaggtatgcataggatatcatattagttggaaatattgatctagataagtcaaatagcagcaaagctcttaattcggttttattttttcaaaaagtagctatcgccttattgatatcttatcaaaattaaacttcacttttttcaaaaatgtacatgctaagtaataacgtcattataataagcaaaaacactaatatgctcggttccattaagtcttgaactttaaactttccacttaatatttctccttgtttttggataagaagcataggattatagcttttactgattttaaaaaatccagatactacacataacaccaccataaaaagacaacctaacaaaccccctaaagttttacgaaaaagaactgaaaaaaagagtattaagcttatgaaaagaataccgataaaccatgttgcaccgtaaaccattaatttatgacttccttcgttactaaagtaatataacgtataactaaaatggatgacaacacttaataagtatgacactgtccatagaagggtaattactataaatttagcaaggattataacttttttggctaatcccttcgtaactagattaattaaggttccttttgaaaattcttgcgtcagtgtactactaaataaaaatactaaaataactaaaccaagctgattcatatttttaaaatactgaatataagaatcaatataggtaggctctggtatcgctccctgtagttttttaggtaaaattcctgccataatatcaggcatcataagtgcagttaagggacctaatataccaaatattgaacaagtaatcagaatagatataactttgtatgtcctaacattctccatccattctttttttaacattactgctaaagatttcatttggtaacctccaaataaagctcctctaaactattgtcaatgacttcaatagctgatgggctaatctttaaagaaactaaatcttggtaaaaaccagctagtaaatctgctttgttatccattttagagcctttgagagtcagtgcatactcattatctttcttttctatctgatagttatgagatagtaccttagcttcagactttgtcacttttattaaaatacgaaccgaataattttcctctgatttttttccttttaactcttcaagagaataaatcccacacttagttaacaccagaacatgatcacatattttttcgacatcagagagaatatgggtagaaaaaatcacagttttttctcctctaagatttgaaataatatctaaaatatcttggcgacctttcgggtctaatgcagaggttggttcatcgcaaataataattttaggatcatgaaccagtgcttgggctaatccaagacgctgtttcattcctcgagaataagtagcaatcttttggtgattatcgtcaagtccaactgacctaagtagttctttgttagaaagcttatgctttgatctcgctaaaccagaacataaatcaagatattctagagctgtcatataatcgtagtactcgggaacatctgggagatagccaatcagttgattggtatctgttcttccaaaattaacttttttaccaaaaattgttatgaaacccgtatcaaattttaacaatcctaaaatcatttttattgtcgttgttttacctgctccatttggtcctacgaatccataaatcatattttcttctaaatcaaaagaaacattatttaatatttttttaggaccaaaagattttgtaacgttttgaaatgagatagctttcattcattattcccttccaaaataagaaatgcaattggcccaattatattaagaaatataatgaccaaaaaccaaactggctttgaaaggtgtttagtcatcttaagtttacttagtttgactagagaaatgataattaaagctccttgcaacataatcaacggaactaggaatggtaataattgatttggtatttctgtattcatattagtaatccttttttaaatcgttaagtttttgaatcatttgttgaaattctttatgccctgatagttctttaaattgtgaattttgaaataagtcctcaactcgttctattacctgtaattgactcgtcggtggtgcaataccagtaggtattgtctctaaccaatcatcgatggtataaaagaaagtatcaccgtgtaattcaaatctttggagcaattgttttaaagatttaaaacattgttttaagtatcctaatgccttatcatcatcacttttactataatgacaagctaaactataataacacttgatgactgtgttgggatgcaaagagtttaattgaaacgcttctatcatatgttcaagcctttcaaaaatatcgcctttgttttcttcaacttcaaaagttgataaactcaatagatactcgcatacaagtagaatctgctgataaatttcaacctgtaatacttgcttagctcggtaaacatcgacttttgcaaaaaagctattagctaaaagtaattcttcacctaatttatagggactattctggtaaaggtttatcacttcatcatattcaaggttgtgaaaaagaacgaccgttttgaacattatcgccgtctggaggtcagactcaactactgttttactaataattttatttagtgtacttagtgaccactctttcatttctgaatcattaaggttggttaggttgctcaagaccatattaatcattatcaacagagtcttaaaatcgttagggaactgttttgataattccttaacttcctgaaagaaatctctctcagacaatacatttgcttttatttttagatccttaatgagctgatttctttgatcatctgacaatgttttttgataaccgactaagtcatccaagctaatatcaaaaagattagccatcaaaataagatagtcaatatccggtttagcttgattattttcccactttgaaattgtagtttttgttaaatgcagataatcactcaaattctcttgcgtcataccaatctgagtacgttgtaaatagatattctctccaagcatcggtcaatctactttcacgtccattatagagtttctaaatcaaaaataaaagttcctatcaggaaatataatataaaaaagtttccctagaagaaactttttcgttgattaataagtggcaaaacagcattaataataacaatggttaaataaaaattaacttcactaatatttgtcattgaaaaataatgaattataaaagagcccttaagaaaggctcttttataattcattggtaactactatttttattgtaactctttcaaagatacaatagcagacaaaccataatatgacgatgctcctagtaacaacgaccctaaaatatccgttaaaaaatgattttctaaatagagtcttgaaaaaataactgatgcaaggatcactaatgcaaatattacgaaaactacttgtgacaatactcttctcaatctctgtctcgcaaccactaaaacaagaatcattaataaaaacgctgatatcgtatgtccactgggaaaactataacccgaatcaaaaacaagttgattcataggtctatgacgtgcgatgatatcttttaaaagcaatgccaaagcattggtaccaaaaaataacataaatagccacacagctattctttggtttaaaaaatattgatacccaaggataacaagtgctattaatgacgttgtcaaagggctgacaactgttgatattatcgtcattaagttagttaaatcgggatttcgtatgctttgaaaaaaagctgaagtgatattatccaaataacttatcatatcactttgagatttaactgctaatgttaacactaaaaaagaaacaagtagtataacacactggaaaaaggatttcttgttcactacataacctcactttaataaagagataaatcttcatacattatggtttaaaatatttaaaaaatgcttaaagtacgcgctaaccttttaggtttaaatatgactattcacaaactagaagaaataccaaatacgaacttttcctattaattagcgttcaaattttcattaataaagcaatattgctacaatatacttgaaacggagggaataatggatattacagattatcaaaaatgggtgagtgaattctataaaaaaagaaactggtatcaatacaattcttttattagaagtaactttctttcagaagaagtcggcgaattggctcaagccattcgcaaatatgaaattggacgtgacagacctgacgaaaccgaacaaactgatttggaaaacttaaatgatataaaagaagaactaggagatgtcttagataatatcttcatacttgctgatcagtataatatctcactagaagagattatcagcgcacatcgcactaattagaaaagaggtttgaaacatgagaataactattttttgtggagcaagtactggggaaaatcctgtttatagtgaaaaaacagttgccttagcacaatggatggcacaaaacaaacattctctggtgtatggtggaggaaaagttggcttaatgggagtcatggctgatactgtgattgcaaatggtggctacactactggtgttattccgacatttttaagagatcgtgaaattgcacatgaaaatttatcagagcttatcatagtaaataatatgcctgaacgtaaggcaaaaatgatgctacttggagatgcctttatcgctctacctggtggacctggtacccttgaagaaatttccgaagttatctcttggtctcgcatcggtcaaaatgataatccttgcattttatataatgttaatggctactttaatgatttaaaaaatatgtttgatcatatggttggtgagggttttcttagtctggaagatagagaaaatgtcctattctcagatgatattactgaaatcgaagattttataacgaattataaagtccctagcacgcgccaatactagattgataaaaaaaggaagtttctaattgaaatttccttcttttttcgaagcgattacccttggttcatttttctttcagctggtcaagcccatcctctcaatatccaaactcatcctttctgctcgagaacttataaatttttaggtaatctttagagaagccaaaactatagtcttgtctatgtattttatcttattagaagtatccaagtgctcgtccctattgactaatgacttagaaacctatacattatacattataatatttctttgtcgttaccgttattaataaggaggtaatcaattgaatcaagaaaaaaagagacttaacctaatcgggctgatacttttagctcaggctattgttttaagtttggcgactacactatttgctgaaatcttacaaaatgatgtctggataggtatagcaagtactttaatcgccttactcattccttgtttttttatgggttttaaaaatttaaaaaaacatctaacggcaacccatcatacaatcactttcaccactattttattcttgttaagcattatatatactactaataatatagtctccacaatatgggatgttgtgctaaatcatctcaatattatggaatcggaaagtcaaaattatgatgccacattcaatatacttatgattagttattctgttgttgtaggtcctttttttgaagaagttttataccgaggaatagtattgaatttattatccaagtatggtaaatggtttgccattatcacttctggcatcctatttggtttaatgcaccaagacatttctcagctattgactacatctattgcgggtatcataatgggttttatcgcttaccattattcctttaaggtagccctactccttcatatctgcaataactttatcgtagaaattttcacccagctatcaacagtaaacgagttatacgggacttattttgaaaatatattgctaattttagcaatcttatttatattatattacctttttactcataggaatactgctcgccgtcgtataagtctgcactctaacgttcgagaggctgactcaataaactctaaacaacatacaaaattattacttactagttggccttttattctccttgtcatttacgacattgtcctaacaactattaattaagaccaagccacaagacacaaaaagtatggttttgaaaaggataatcatcctccttttcaaaacacatacttttctttatgtttactaaaaggtcattaatagtgagataatgtcaatttttttattatcaaatatggtagactacacaggacatatttacacttctagatttcctctccacgcttctgtgccgccatctacattgattactttgtagcctttcaactcaagaaattggcatgctctaatagatcttccccctcgttgacaaacaagataatattccttatttttatctaactgttcaaacttatgactgagttgactcaaaggaagatttatcgcacctgaaatatgccccccacgatactcatgctcttcacgaacgtctatcaaatggatattattatgctgggcaatcaatgtttctaatgctacaacagttatctttttagtcataatctttatttcctttgatacttggcaaatttagtcaaatgactaatcactttattatttaaaatggtgacatcgttctactattatgactattatcgtaaaccttttaatcataaaaaccatggtagtacaaaatcacgaagtcgacagcatcacacgaaaaatacaaatattattttaatgctgtttgaagtgctgcttgtaatgttacaatctcttgatcaacttgttgtaccgtaacatttggattcaactgaactccaacagcatgtgtgattgctttatttaaagtattgtaaactttaaattctttgacgttaagtacttttttatctctagtaaagcgtgtattccagatttccttatcaagttttgattttgtatagattgtagctctatcagttggttttaaatcaggataagttaaaaccttttgttctaatgcctttacatcgttaacttgagctttaattgaatcaactgaagcaaatggatctaaaatgcgaataaccagcttagttatcccaaatcccatatcaatatttgcttgactaaccttatttgctaaatgttgagttgaaaaagtgattgcttcaatcacatctgttaaggcttctacacgactaccaatagaattcaaatcataaactgtctcagggttggcacgcaatgaagtctttaatttttcaacactagtaatagcctcattaaccgttttttcataatctgttccctgaacattatctttgatatttctcaactgaatgctatcttgatcaagcttttgagccatttgctgggcttgattattactgtttacatgatttaccacttgtggagttgtcacttgatcagcatgtacttctaatacagctggtgaaaataacaatgcaccagccactagagttccagatagatacatcatatgtttaacgttcataatgaatttcctcctttaaactaaaatcacttttactgcagtatttttaatttacagggcccatgtttgtatcttactacttgtccaaaaggtcgtcaagcgctttcttttcccctatattttacattattacaaataaactgcatttttttcataaaactaatattatcattttgctataatatacttgcgcctatccttttgttaatttctgataatttaatttatattttcatgtaaaaaaccataacgataatttaccaccttatataaatctaaatattttagaaaatttctacttatcactatttttatcaaatagattagcctaatgtttttcttaaaaaataaatttaataagaagcgtactattttagataaaatcgttccattatgcccaaaaaccatactaaaactcattatttttactttctgtttagaaattcatactagaccaagtattttagacacttaaaaagccttaaacataataagttcaagactttttattacttagtattttaaactgtgagtttgtttggcagttccctccgatgatttttaccccaattttttgaaccaaaagttaacaatatcgtcagccatagtattgatatctagattacatttactggtaactatgttaccatgtgtatggataacttatatcaaaaatatattaatctaaaaaagtgaataacccttataaaataagtaaatcctaagtacagcattaacttcaagtaaacaatttaacggaggtagtatatgaaaatagcaataatcggatatagtgggtcgggtaagtccactttagcaagaaaattgggaaattactataattgcaatgtattacatcttgatagtattcacttcgccccaaattgggaagagagaaaatatgatgacatgattgacgatgtcagcaacatgttagaaaaaagaacatggattatagaaggtaactacaaaaaactgctatatcaagaacgtctagcagatgcagatgagattattttttttgactttaatcgcttcaactgcttgtggagagcattcaaacgttactgtaagtttcgtggtaagactagacctgatatggccaatggatgcccggaaaaattagattttgaatttatcagttggattcttaaagacggtcgctctgacaaacaaaaatcaaactataaacaagttgttgaggactaccctcaaaaaataaagattctaaaacaccaacgcgatcttgatcaatacctaaaagaactccctgttgcatccaatacagaccctctcaagagcttgtaattattatactgacagtatttactcgtatatctcgctttaccttttctattcttattcttgaaaattaaattgtttttcatgttccaattttctgaatattctgctataatatgataatcacttggtcaagagacaaaaaactattcacttttagaaaatagctgtctctaatcgacctttggaatagaggaggacactgaatgacaacaaatgtaatggcaaattatagctacggagaagattgcttcaaagaaattcctagcgttttggcaacttaccgtattcaaagcattgctttcgtcggtggcaaacgtgccctagacagctcagaagccgaggttcgctctattttagaggaagcaaatattaaagtcacaggaagctttgtctatggaacggattcaacacaatctaacattgacaagttagtagccaacccacaagttcaagccgctgatgctatcttaggttttggcggtggaaaagctttagacacagctaaaatggtagcaaaagagttaggtaaaaatagctttactatcccaactatttgttctaattgctccgcaggtactgccattgcagttgtatataatgatgaccattctttcttaagatacggctatcccgagtctccacttcatatttttatcaatacacggattattgcacaggcaccaagcaaatatttttgggctggtattggggacggtatttcaaaagcccctgaagtagaacgtgctaccttagaggctaagaccaataaactaccacatactgcagtgttaggacaagcagtcgctctgtcttcaaaggaagctttttatcaatttggtgaacaaggtctaaaagatgttgaagctaatttagcttcgcgtgcagttgaagaaattgcgcttgatatcttaatctcaactggctatgcttctaatttagttaatcaacctgatttctactacaattcttgtcacgcgcatgcattttactatggtacaaccgctattcaaagacaaggtgaattcttacatggcgttgtagttgcgtttggtgtgttagttttacatgcttatttcaacgaactagaagaacttgaaaaagtagctcgttttaataagtcactaggtttgccaacaactctagctgacgtctctttatcagaaaaagatattccaaaaattgttgaaattgcaatgactactaatgaatacaaaaatacccctttcgatcccaaaatgtttgctcaagctattttagcagcagacgctttcggacagacactagcctaataattcaccaactcgattattccgatacaaaaatcccttagacacatcatctaaggggtttttgttattaataaagtaaaaatactgctctccattataggaagttgcagtattaatttaaattcttagtattgtatcagtatttttaaataactgctaaaagattatttttgtagttgtttcaattgtgctaactgatttcccaatgatactagcatttctgtctgtaacttttgaatctctaacaattcaaactgatcttgttgtaccatatgatcaatcttttcgtgcaataatctaatttctaactcagaggttttattgacattaaagtcatttcgagcttgcaaacgatcataatcagcagcacgattttgactcatcataataagtggtgcttggattgcagcaatcgttgataaagctaagtttaacaggataaatgggtaaggatcaaattgaataccaaaaggcttcatgatattaaccaacatccaaatagccataatggatacaaaaacgataataaaagtccaagatccgccaaaacgtgcaacatcatcagcaattcgttgaccgatagttgcttgcttgttcaaacgctcttcaacgttgaagggcttctcttcttctttcatcaaggtagtcacattatattttatcttctcatttttctgattcgctcgctgaacaatttcgtcaagataattcatacaataatgacttaaatttccatacgaaataaagtcactatccagagcaaaaggataacgtgctcttattaaacctttaatgcctaagtctaaatcggaaacaaataggccttctgcttcactataaactttttgatcaataaaatcgacacataccatttttatacctccctttctcaaccaagatttattcaatatttgaatacggtcaagctagccaacaggctataggcttttggtactatataagtgagtatttgatacacccctattaagctttacagcgttatttcgttagtctaaaaaaatcgctgacatccatattatgccttaattttatgctacccatcaaaataacgctttattctaagtctataaacttaaagaaaacttaaattaactaatttatcttagtatagaaggtggcttaaaaatctagtttaacctctgttttggtacgtaacttttattataataataaacgaccaactaaaaagtaagaaagttaagaggactttcttacttgctttttttgtatatagtcaattaactcaagagtcagatcatagcgtaaaaagggagtaatcaaatagataccattaaaatagttcaaggcttcatcaatcaaggacttactctcgtttaaggccaaagttaaacaagcttctttgtcgtcctttaccttttcaagagcagataaaaatgactcagaaagtttaataccaggaacttcattgtgtagaaaaacagcgttattataacttgttattggcataattccgataaaaaagggttgttcaactgttttagtaagatcagctaattcctttaacacagagtgatcaaatattggttgtgtcataaaataatcagcaccagaagctacttttttctcaatcaattttacggttcgagtaaggtttttcacattaggattaaaggcagcagcaactgtaaaatctgttggacgtctcaagctagcaccactataagataaaccttgattaagttgtttaatcagagaaaggagtttaaaggaagtcacatcataaacactagtcgctcctgggaaatcaccaagtttagtcggatctcctgttatggctaaaatatggttaaaacctaataattccatgcccaacagtctagactgtaaaccaattaaattatggtcacgacaagctatatgtagtaaaaagggtgtgctaatttcatctttaagcaagctagctatacttaaattacaaatacgtgtattagatagtgaattatctgctaaagtaattgctgcaatacctttttggtcaatcgctcgtatagccttttgaaactgaacgatatctaaatgctttggaggatctaattctgcgataattgttacttctttttttaccttatccactagagtatctgttcgtctgatacgcctaacaaaatcttttacaggtattataggagtaacaacctttcgttcaataggtttcaatcctctaatagatcgtttcacagctctaatatgatctggagttgtcccacaacaaccaccaataagcctaactccttctgctacgagaagttctgcagattttccaaaatactctgaattctgactaaactggtattgactattctcaccatctaaagataactgacttgcattaggataaactgacaaataagactgggcaaataaaggaacttgcttcaatgattggatcatatgatagggtccaaggtgacaatttaagccaatcacatctgcacctagcataactaattggctgagcgcctctacaataggctttccatttgatgttacccctgcttcatgaagagaaatattagtaataattggtagatcagtcatctccctcacaatttttaaaactgtcgttatctcctcaatatcataataagtttcaaacaataatccgtctagctgtcctgtcgccaataaagcctcaacttgttccaaagtttcttctacaatattatccaatgttaaatcgcattgtctttgagaacgaaaacctccaacagtacctaaaataaatgtttctttacccaaagtcgcttgatgagctatattaactgctgcttgattgatagagacaacctgatcttccaaaccgtagttctttaatcgatgacgttgagccccataggtattcgtctgaataacatctgcacccgcttcaatataagcttgatgaatggctagaaccttttctggatgtgttacattgtaggattcatgacaagtatctagcccataagtataaaggagagttcccattgcaccgtcagctactagaatatctgtttttaatttctctaaaaacttggacatcttctttactcctccctcatggcaatcctttactgattaacctattaattatctaattgctgacgaacctctttggtagctgaaacaagaacctccaaggcagcaattgtttctgcttcacggcgtgtttttaagccacaatcagggtttacccaaaattgctcttttgatagacattttagtgatcgttgaatattgacaataatttcttccttagtaggtatgcgaggggaatgaatatcataaacacccaggccaattcctagaggataaactgctgtttcaaaactttcaatgatgtccccatgacttctactcgtttcaatagaaataacatctgcatctagtgcacggatagaatcaataatttcgtcaaattttgaataacacatatgtgtatgaatttgtgtctcatctttcacagatgaagttgcaattttaaaggccgcaacagcatcatctaagtaagcctgttgcttttgctggcgtaagggtaaaccttctcgaagggctgcttcatccacttgtataatagcaatacctgattgttccaaaagttgaatctcatcttttatagccaaagcaatttgattaaaaagatcagatcggctaatatcatctcgctcaaatgaccagttcgttatagtaataggacctgtcaacatgcctttaacaggtttcttagtcaaactttgggcataaaccgtttcttcaaggcttaagggttgaatatgtttgacatcaccataaatgataggtggtttgaccgcccttgaaccataagactgtacccagcctaatttggttgtcgtaaaaccagctaacttttgaccaaaaaattcaaccatatcaacacgctcaaattcgccatgtactaacacatcaagatcaagatcttcttgaatagcaatccatcttctaatttcagtttttatgaaatctttataatctgagtcagatagatttcctcttttccaagcaaggcgtttcttcctaatttcaggtgattgaggaaaggatccaatagttgttgttggtaaaatcggtaactgtaatttttcagcttgcaaagcttggcgtaatttatacggacttcgttcaagctttacttctgctaatgattccaatgctacatgacgaaaatcagcagcttgaagagctgaaaaacgagataaagcttcgtgatatccctttgttttattaccatcaaaagcactagctaatagttctaattcctttagtttttcatcagcaaatgataagccattctttaacacagggtctaaatgtgtttcgtatttagtcgtcaccggtacatgtaaaagacttgaagaaggttgaagagtcaatcgtttaacaaagggacctatctcttccaataaagccaacgtttcttctaaatttactgcccagatatttcgaccattaacaattcctgcaaataattctttttcgcggaatagaccttgcttaacagcagctaaattttccgccctaccatgtataaaatcaaggccaaatcccgttactggcagcttagagagtttatctaaacagactgctgattcaaagtaggtttgaaagatgaagtgggcttgtggtacttctcttgcaaaaaaatcataaacagacttagctatatctactaaaagttcaccttcatcagttacaaatatcggctcatcaatctgaatataggtggcgcctgcatctatcagatcttgaaagacctgcttataaagtggtaataaccgctgaacagtcgcttcaaagtcgacaattcctgatgataaggaaacataggttattggaccagtgataaccggctttgctttatcaccaactacttccctagcttctagataaagatcaagtaagtaattattctgcaagtgaggtttagtctcaacctcccattctgggactatgtagtggtagttggtattaaaccactttttcatagatgatgcgacattatctttatcacctcttgcaatagcaaaataaaggtctaaattcctctcatactcatcgaaacgctttgggattacattgaattgaaatgacaaatccaaaacatgatcataacaagaaaaatcccccactggaataaggtcaatacctgcctctttttgtttctttaaatgattgatacgtaattgttttagttgtttttctaaatctttttgttcaagattccctgcccagaaagcttcgatcgcttgcttccattcgcgctgttcaccaagacgtggataccctaaatttgaaacttttaccataatttcctccatcaagttatagctaataactaacccttttagttttatgaattattttagtccatgaaaactataatatcaatagcttttaatattttatatttttagcgatttatatagttttaaactatataaaccactatggacctttttataaattttaaaacagcagcatgtagatatctttaaaaagcaatcttacaatcaactcatattatcaagatacagaaaaatctgttgatattattaacaattagtcaaactattacacatcggctatcaaaagttcctgtctagacaaaaacacaaaaaacgtatctagaaatagatgcgttttttgtgtttttattaatcttccattcctacacgttaaaatagtaatctcaataaagccatagtaacgataccagtaagaacagtgtaaaataaatttcgatatcgaatagtgacaactagagttggtatgccagccaataaatctaaccattttagtgttggcaattgtcctaatttaactgaaaaaaagctagagaatgttagggcaaataaaatagaaagaggaagaaattttaaaaatttcacaagactatttggtagccctttgtattttacaaatatgaatggagcgactcttggcacccaagaaacaacaaaacctaaaagaatagcaagaaaaacggtactatttatcatctaaaacaactcccacactacatccaacaacagtcgcaagcaatactgataaggctcctgacaaaaaagtagctaataagaagtaacttaaacctacagaagcaagaacatatacaacaagtcgctttccatcagataacatcccaaacaactgaaatacaaagagacctataaacatggcgactaatgcaaagtctaaaccaaacatttctggattaggaatagtactccccagtaaagttcctattatcgttgagattacccatgtcaaataactcatcacattattaccatgcatccaactaggcgatacaactttgtgatgtaatgcttctccaagtaaaacgccgtagctctcatctgttattagagttcctatggctaattgattcattaggtgagcagacttgaagatagtagtcgcgtgtaaactcattaacatatttctcaaattaactaaaaatactgtcatcgtaatagtcatcaagtctgcttttgctaataatagcgcacacatagcaaactgagcagatcccccatataccaaggcactcataagaccaacttctattgcagataaatctgatgctgaagcaactatcccaaacgccaagcctattgagatataccctaaagctgtgggcaaggcatctttcactccctctttaaatcctttttccatcatatccccctaaattttcagtatattcagttattatagcacaacggtgattactaagaaagaagaggaatgattatttatctttgccagcaattagactaataaatatcctgtaattattctataaacctttgatattgtagccatatagttggacaatattattattttcatagaatgatttttaaaaaatgctttaggtacggtcttaaatttaccacaaaataatttgtaatgaaaattcagaaaattgtagaaaattttgattttttatgttttaatagtttttgtaattattatgttacaagaaaaggagatttttatgaacacaaaacagcgtttttcaatccggaaatataagttaggtgccgtatctgtacttttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaataaaatactttaaaaaatagagcaaggcatcaattactagctattaatagttagtgactggtgcctttttgaggagcttaaaatgatgttcctaaagaccttttctctgcagtatcttggtttataacaccataacacttcaaagaatgggaaaaaaactctttttttgttatatttgatatgacataaacagctagctaaaagtcaaattataactatgggtattgaggtatacatgacaaaaataatttatttcgctgatgatgaaaagaatattcgtgacttggtggttccttttttagaacatgatggtttcactgttcgagcatttgaaactggagaccttctcttagaagcctataaaaaccaaaaacccgatttagttatattagacataatgatgcctggaactaatggtttagatgttatgaaaagcatccgccaatatgataatattcctattatcatgttaacagctagagattctgatgttgatttcattacggcttttaatttaggaactgacgattacttcaccaagcctttttcacctataaaacttagtctacatgttaaagcattgttcaaacgccttgatgaaaaagcaatcaaaaatgacactcagtatcagttcctagatttaactctggataccgaaaagcgaatagccctattatcaaatgaagaaatgcccttaaccaagacagaatttgattttcttttagtattaattgaaaaacctgaaactgctttttctagggaaacactgcttaatcgtatttggggatttgatgatattgaaagcagagcagttgatgacactattaaacgattacgtaaaaaatttaagcaataccacagtcaggttagtatcaaaactgtctggggttacggcttcaaattaatcaaagaggacaaatgaaaaagaaaagtttaattagcaatcttatccttattaatagcatcactctatttcttggtttttacctcatctatttttctgtcaactatgtcattaaagactatgtccatcaaatgacaaggaattccatgcaggcgaatttcaccattttagatagtatctataacaacaagaaaataccagatgaaaatatggttaaccaagatagcatctttgtttggtcttactatgctatttttgaccagcattatcgtatgaaatatggcactgataatcataaaaaagagagccatgatattattcgctatcttacccaaaaaagattgtggcaaatttctaaggaaaaagatggtatgtttgtaaccatcaagaaaaaaacctattatgtaatgaccaaagactactctggtatccttgttgatggtagcataaaaaaagttcctaaagcacagtcgcaactttttcatgtgattaacttttcagacattacttacacccagcatctaattactaaaattaatcattttcttatagttatcttagtactaacctatattcccatgctatttattatgaggaagactttcactggaattagagaatctattcaatcagtacaaacttatatttccagcctttggaaaaatcaaggcaatcatcaatctagtcaaaaagaaattgtcttttctgatttcgatcctcttctacttgagagccaagaaatggcaaatcgaatctaccaagcagaagagagccaaagaaacttctttcaaaatgcctcccacgagttacggacacctttaatgtccatccaaggatatactgagggagttcaagagggtattattgatgccgagctcgcacactctgttattctgcaagagagcaaaaaaatgaaacagctcgtagacgatattatcttactctctaaattagatagtaacttaagtgatcaaaaagatgaattttctttaaatgaattacttaatagtattattgcttatttcaaacccctagctaataaacaaaagattagtattacttatagaccagacaagcatgaaaagttactaaaaggtaacgaagagttgattcaacgagctatcaataatatccttagtaacgcactacgctatgctgtttctcatattgaaatctcttacacaaatcaaaaactaactatctcaaacgacggaccagccatttcaaaagaagacttgccttatattttcgatcgcttctataaaggacatggcggccaaacaggtattggacttgcaatgactaaagaaattatcaagcaacatcatggtaatatcatcgctgagagtgattcgacctcaacaacttttacgatttatttcaattgccacaaaattgcctaacttttcctacaaaaattcaaagaagttattgcttttttaacctataatacctatagatcaaaaagttattctaaaagaaagtgagtttttatatgttacattctaaaaaaatacattccttatcgcttattgccgttctctctttagcaacatatacgagtttacaaccaaatcatgtaacggctgaacaatcacaaaaaacatcaactgttcatatgagtcaaaaaactattgaacataagttaaaagttgcagataaagaagctgctcctctctacgctaaaatcgaccatatccaacgacatattgaagtcaaaaaagcaaaagatttaaaagttattgaattgtatattaacaaagatatcaaccaactagagaagcaaaataaacgtctactaactaaattctatacttctattgataatcaaacatgggatagcacaagtgaagtcaaaaaattgattgataagacaaacctatccactaacgaaaaagatagattaaaattatattttgaacaacgtgcttaccttgagacaaggttgaacgaccgctatcaaaaatttgataactctattgaaaaccaaaataaagaactaaaaatattaacgtcaaaaatagaaaaaatctatcaaaaacatggtattacaaaagaggtattaaaaacttactatgctaaaaaaacagtacgagctgactgatttagctaaaaatagaaaaatcccaaaagttaaacttttgggattttatacgcgtaaatatcactatttctagtaaaatctttatcttatttcaccacaatattaacgagtttgtttggtactgcgatgactttgatgatgtctttgcctgcgatttcggcttggactttttcgttagcaagagcaagatcttgcaattcttcgcgtgaaaggtctttagcaacgacgagtttagctttgaccttacctttgatttggacaacgatttcgatttcgttttcaaccaatttgctttcgtcatagcttggccatggcacgtaagagattgactgtcctgaggctgtcaagacttgccagagttcttcacctaagtgcggtgcgaatggtgcaatcaattgaacaaagcctttggcatagtcgctaaagagtttgtcttccttgttggctgcattgacaaagaccatgagttgagcgatagctgtgttgaatttcatttggtcaacttgctcagtaactgccttaacagtttcgttgtaaaccttgtcaagagctccgctattttcctcagtgatctctttagtcgtgatcaaacggtaaacacggtccaagaacttacgtgagccttcaagaccttcttcagaccaagcgattgaagcatcgagtggtcccatgaacatctcgtaaacacgaagggtgtcagcaccgtactgctcaacaacatcatctggattgacaacgttcttaagtgatttagacatcttagcaggtgcttgttcaagctcttcaccagtttccacatggaagaagctgccatcacgtttttcaaccttgtcagttgccacaagagcaccacggctgtcgcggtagcttgttcccaaaatcatcccttggttaaagagtttttggaatggctctttggtaggtacgacaccgagatcataaagaaccttgtgccagaagcgagcatagagaaggtgaagcacggcatgctctgcaccaccgacatagatatcaactggcaaccattgtttgaggagttcctcgtcagctagtttttcagtgttgtgtggatcgatgtagcggagatagtaccagcttgaacctgcccattgtggcatggtgttggtctcacgacgacctttaacgccatcttcacgagtgacttccaaccagtctgtcaagttagcaagtgggctctcaccagtacctgaaggacggatatccttagtaactggaagaactagtggcaattcgctctcaggaaccgcagttgatgttccatcttcccagtggatgattgggattggctcaccccagtaacgctgacggctgaagagccagtcacgaagacggtaagtaactttctcattaccaacaccttctgcttcaagccactcgaccattttggcaatagctgccgctttgtcgagaccatctaggaagtctgagttgatgtgaagaccgtcttctgtaaaggcagcctcttcaacattcccaccttcaagaactggaatgatgtctaggttgaattgttttgcgaattcccagtcacgttcatcgtgagctggaactgccatgatagcacctgtaccgtagctagcaaggacatagtccgcaatccaaactggaatttctttaccattaactgggttaatggcataggcacctgtccagacaccagttttttctttggcaaggtctgtacgagcaaggtctgatttgagactcgcttgacgtttgtattcggcaacggcttctgcttggtcagctgttgtaatagcatcaaccaaggcatgctcaggagcaagaactgcgtaagtcgcaccaaaaagggtgtcaggacgtgttgtaaagacagtgaagtccttatctgtatccttaaccttgaaggttacattagcaccagttgatttaccaatccagttgcgttgcatgtccttgattgactctggccagtcaacttcttccaagtcttccagcaagcgctctgcataggcagtgattttgagcatccattggcgcattggttttctgacaactgggtagccaccacgttctgatgtaccatctggaagaacctcttcgttggcgatagctgttcccaattcttcaacccagttaactggaacttcagcttcgtaagctagacctttttcataaagcttggtaaagatccactgtgtccacttgtagtagttagggtcagttgtgttaacttcacgatcccagtcgtatgagaaaccaagagcattaatctggcgtttgaagttagcgatgttttcagctgtaaactcagctgggtcattaccagtatccatagcgtactgctcagcaggaagtccaaaagcatcccaacccattgggtggaggacattgtgaccttgggcacgtttgaaacggctgagaatatccgttgctgtatagccttctgggtgaccaacgtggagaccagctccagatgggtatgggaacatatctagggcataaaacttaggttttgatgcgtctgttcctgttttaaaggtatgattatctgcccaaaaagcttgccatttgggttcgatttctttgtgattatagaatgtcatcgcacttctccatgtcaaaaaagtatagtcttcttattataacacgaaaaatagcaataaaaaaggtgaaaataccctcaacagcaggttctctccccacttatccttgacaataaactaaacttactctatactatttccaaatgacataatgctttaaccgtgtcctgtgagacatataagcgaccaaaataggattctatacagaaatcctactatttttgcgagcgtttatagaactcaagggtagcagcttgagttttttcttttacattataatgagttgaagcagctatgacatctctgttttagaattttttctattgacagtatttaataacggtggtctgtgagccatcattaaaggaggagacttatgtcaccattaaatatcaataagaataattggcgcgccctaatcgctgccattgtcgcatccggaaccgatgatttaaatatcatgttccttgcattttctatgtcaactatcattactgatcttcatttatctgcggcacaggctggttggattgggacaattaccaacttgggaatgctcgtgggaggactaatctttggtttattagctgatcgctacaataaatttaaagttttcaaatggacgattctaatcttttcaatcgcaactggtttagttttcttcactactaatttatcatatctctatatcatgcgcttcattgcaggaattggcgttggtggcgaatatggtatcgctattgccattatggcaggaattgtcccaactaataaaatgggccggatttcttcactaaatggtatcgctggtcaagttggatctattagctcagcactcttagcaggatggctagctccagcactcggttggcggggactttttctctttggccttctccctatagttctcgtcctatggatgcaatttgctgttgatgataaagatatcttagatcaatataatacagacgcagatgatgaacctctagatatcagtataaaagctttatttgatactcctgtattagccacacagagcctagcactaatggttatgacaactgttcagattgccggatactttggcatgatgaactggttaccaactattatccaaaccaacttaaacgtttctgtcaagaattcatcattatggatgattgcaaccattcttggaatgtgccttggcatgctagtatttggtcaattgttagataaatttggaccgcgtttagtatacgggtgtttccttctatcatctgcaatttgtgtctatctctttcaattcgcaacaacaatgccttctatgattataggcggggcagttgtcggattctttgttaatggtatgtttgcaggctatggtgccatgattacacgtctctatccacatcatattcgttcaacagctaacaatcttatcttaaatgttggtcgtgcaataggtggcttttcatctgttatcatcggaatgattctagacgtttcaaatgtctctatggtcatgcttttcttagcaagtctctatatcgttagttttttatcaatgctaagcattaagcaattaaaacgtcaaaaatatcacactaatttaacacaattagatgtcaaaccaactgactgatattacaaaacagtattcctcaattgagaaatactgttttctttatttcattagataactattcagctcaggcatcacacttttagcatctttcataccaagctgataaatactatcaagtttatccggattcttctctaagcggccaataaccaagctcttactcggtctaattgcaaatagatcgcctgttttttcaaggctcatgaccttttcaagactattattatactgttggtaccgattcgaggctgtctttacaaaattaggatatttcctatacagagttttatacaatcgtccacttgaaggctttttctgataattgagcggcctagtcatcacaacaatcaacttgtcaaatcctaaaccacgggcaaaatcaacgggaatactatcagataaaccaccatctaagtactttttcccctgccaatcaaccatctttgagactactggtaatgctgaactagcacgtaaaatttccatttgttcaaaaacactatcaattttaaaatattcaggtttaccagatgtcatctctgtagcaactacgtaaaaatcaatacttgattttttaaatgcttcatcgtcaaatacatccaatttcataggaacttcataataggtgaaatctttattaacaaaattccctgttcgaaaccatgaccttagactcatatatttagggtgggataaatactttttattgtatcgcaaagccctctctcgttgtctagatacaaaattaacaccaaacaatgcaccagcagagacagatacgataccatctatttttattcctgcatctagaaaagcatctaaaactccagcagtataaagacctctcattccgccaccctctaaaactaaaccaacagacaacataggcaatcactttctaatattgatatttgattaaagtatagcaaaatatagctgttttttctgaaaaagaatatgttgtactatataaactccataattaatttaataataatttctgaatcacactcacctatgatagaataatactaatagtttttaaatttatatttactatatctaactaatataaataaaggattttttatgacttatcaaaaaacagttgttttggctggtgattattcctacattagacaaattgaaaccacattaaaatctctctgtgtctatcatgagaatctctcaatttttatttttaatcaagatattcctcaagaatggtttttagctatgaaagatagggttggacaaactggaaatcaaattcaggatgtaaagctcttccatgatcacttatccccaaaatgggaaaataaaaagcttaatcatattaattatatgacctatgctcgttatttcatacctcagtacatctcagctgatacagttttatatcttgactctgacttagttgttactactaatttagataacctctttcaaatttcactagacaatgcatatttagctgcagttccagctctttttgggcttggatatgggtttaatgctggagtaatggtaattaacaaccaacgttggcgacaagaaaatatgactattaaattaattgaaaaaaatcaaaaggaaattgagaatgccaacgaaggggatcaaacaattcttaatcgcatgtttgaaaatcaggtaatttatttagatgatacctacaattttcaaattggttttgatatgggagctgctatcgatgggcataaatttatttttgacatcccaattaccccactcccaaaaattattcactacatttcgggaatcaaaccttggcaaacattatcaaatatgagactccgtgaggtatggtggcactataatttacttgaatggtcaagtatcatatctagtaaaaaagtatttggtttagaccacccaattaaaacacaaaattatcgtctcaatttccttattgttacaacttctgattgtataccatctatctcagaattagtcactgcccttccagattgtctatttcacattgcagcaccaacagttatgtctgacattcttataagcctattagcttttgaaaatatccgccttcataaaacttacactccacctattattgataaattattagcagaagctgatatttatcttgatattaatgtttttggaaaaatggagggcattctacagaaaatgtcacaatctgaaaaaccaattcttactacaagagaatgcaatagccagcttgttccagaaacagtttttgcatctatcgatgatttaattaattatcttcagtctatataaaaaaattggcatccattcactatatacccaacattattctaaacacttaactaggagaatttaaatggaaaaagcagttgcacttgcagttgattcaaactacttggataaagccttagtaacaataaagtctatttgtgtttataatagaaatataactttttatttattcaatcaagataccccagttgaatgggtacgtaatataaacaggaaactagagcctctaggatcaaaactgattaatgttaaaatatataactatgatattgctcatctaacgacttttctaactgttagtacatggtttagattatttttagcagattatatacctagttcacgtgtactttatttagattcagatattatcgttaacactaatcttgattacttatttgaactagattttaaaggttattacttagcagccgtcaaagatccccataaaaatgaagaaggagggtttaatgctggcatgcttttagctaatctagaactatggcgggaagatgggctcactaaaacattactaaaaacagctgaagaactccaccgagttgtcaaaacaggggatcaaagtatcttgaacattgtttgccataatcgttggttatctctgaacaaaacatggaactttcaaacttatgatgtcgttagccgctataatcatcgatcttatttatatctaaacatagaaaatagaactcctaatattatacattttttaactagtgacaaaccttggaatgaaaatagcgttgcaaggtttagagaactatggtggtattacttccaacttgatttttgccaattaaccggcaagcaaagaaaagtgatttcttacgaaaagtccatggaattgctttctgtttcagatattcatcttttcactcttacatcttccgataatttagaacacattgaatcgctaatttgtagatgtcctactgttcaattccatattggtgcctacacaacagtgtcaaataaacttagcaaactagaacaatatccaaatgtcctagtttaccctgaattaattgaggcaagaattgaaaaattaataacattagccactgcataccttgatattaatcatggtccagaagtaggtaatattttacaaagagttcatttgaaacaaaagccaatttattctttcaacaacacgtctcatcaagagaatataaccaaacatatcgttaatcataattctattgataatatggttgttttaattaacgaattaaacctaaatcaattataaattaacaaaaatccatctttattttaagatggatttttcagaagttttataattctgcaacttggtacaactcaagttctgcttgtgtttctgagccgaacatgttgatcattaatttaactttgttattctcaatctcaactacacgtccttcttgtccgatgaaagcaccatcaatgatttgaacaacatcaccttccttgatattagtatcaaagacatcaacggtttgtcccattgagatgagtattgaacgaatctcttcttctaacaacggtgttggtttagagcgattgccgtgtgatccaacaaatccagtaacgtttggagtattacgaacaacaaaccaggcttcatcagtcattaccatttccacaagtacataacccgggaagcgattttcttcaatttcttttgttttcccatttttctcaacatttacagtttgagtagggatttccacacgcaaaatgttgtctaacatattataagtttgcgcacgttgcaagagattttcctttactttattttcataacctgagtaggtttggagtacaaaccaacccttatcaaaagaatctaacataagttttcctttccttaataaaaaagccttttacggcttattggactgctattttcaatatatattataaagaaaataaaataagctgtcaattaaagtaccgactaaatcattctaaaattcaaataaaaaaggcaaagttctgatgaggtttgccttaagattttgaaaggatagacctttcggtttatgtttaaaaataaatttaattttttttatgctttaaaactatcgtaataagacctgcacttaacataacaattagtgatacaattgctaagagtggacttgcggcttcacccgttgatggtaattttttactatactttttgttttcaatagcttttttagccgccaagtttccgctagtattaaccgattttttggttgctggtttggcctctggtttagcttctagcttagcctctggtttagcttctgacttagcctctggtttagcttctggcttagcctctggtttaacgtctggtttagcttctggcttaacgtctggcttagcttctggtttggcctctggcttagcttctggcttagcttctggcttagcttctggtttggcctctggcttaacgtctggtttagcttctggcttaacgtctggtttaacgtctggcttatcctctggtttggcctctggcttaacgtctggtttaacgtctggtttaacgtctggcttagcttctggcttaacgtctggtttggcctttggtttaacgtctggcttagcttctggtttaacgtctggcttagcttctggtttaacgtctggcttagcttctggtttaacgtctggcttagcttctggcttaacgtctggtttggcctctggcttaacgtctggtttggcctctggtttggcttctggcttaacgtctggttttttatcttctttagtacctctggtaaggtcttgaagttcttttaaaagctttttgacttcatcaagcattttttttgcttcatcaagtccactttgaccagtccaaacactcctatttccgaaagtttgtttatctctaaacctattcaaataagttcccacagagtctgcataatatccaggtgtaggcaaaatacttttatgcttttcataaatttctttagcctttttagataacgctaatccttttgaacttattctttcaatttttttagcatactgcttttgtaagtttttctgggcaacttcctgtgctgcttgcttaatactatttaaagcattcattgcagcagtaatattgagcttaccttcattatactgtttcactacattatcaattgcagtattatatctcaacatttcatcgttagataaattttctaacttagcaatttcttgctttttaccattggcctgatttaccaacgtttctttattggaattaacaacttttttagcttctgctacaaactcatcaacttgactcttagtgctagctctttgaattttttctttatattcttctaagacttcggggcttatattttttattaaggccacgtcattttgagccatttgcttagcttttgttgattcagcattattcagttgcgtggcttgagttacaaatttaagaataagttgcgaatcttttgaagagctaatagatttaactaaaatatctttttggtctgatgaaaggaaacctaatgacttaatgatatcttgagaacgtcttgactgcttacctagttcttgatcactaactttagcatgtgtagttacacttggtttattttgcttaccaatttgtccttgatataaaatatttctaatttctgcttcagtactattaattaattgtggaagtgtatcctgtgatgctctattaaaatcatttactctacttaaaagtatagcaatagctttgtcattaccacgatatttagaaatcaaattcttcagagtaaccgcccctaaattaacttgtttcttatgaggaattgaagccgatattcctgaactagtatccgcgtgtacaataccactacatacagcaaacgctgctgacattgaggccaaaccataagctgtttttcttaaaaagtattttacttttttttcgttattattcatattcgctcctttatatagttagttgaaaatcctaatttattaggataggaccacgtttattttaatttaatttgagttccttaactaattatataacttggagttttttatttcaacacttttctttaatttatttacattttattaaaataaacatcttttttttaatgtttttttgctcaacaatctagtaaaaataatcaaaagattatttttttataatttaatcggatatatatgttattttccacacaaaaaacccttagtaaaatctaagggtttgggttgtttctatctaaaataatctattattaaaatcgattaatcaagtccatgactcctgcggctaacagtttgtcaaagatgtagataacgattgtgaaaaatacagtgtattccaagatggaaataaaatctttccaacgttgttttcgatttggccaagtagtgtcacgcaatacttgaaaaatccctttgacaaacattatcagttctcctttttgcagtttgttacgctatatcaacgcgtttctttgtgtattgtatacttcttacaatatttacaaaatttatttacttctagtcgtgttggcttgggggtgctacttactccgattgagtaatttcggcttccgcattctgtacacgctaggcttgctttcttttgtgccataacgcctccataagtgctattttaacatgatttgtataatcctgcaagctatctaaagtagtcctttagactattccaagcatcttttaccttctcttggaaatttgaatcttccaccgctctagaaatatcttgtgcagccttacttgccgaatcttttaaatcattaataattgagcgtgattcttggttcgttgtattactagcatcttgtgcattataaactgaaccaataccgttttggaaataagcattctcaatatgagtaaaactagaccccttagtatacggtagtatatatgaagcttgcgtgctaaatatatttgaagctgtacctgcactagaatctgtcaaataatggtgtttatctgtgttcttaaagccaacccattgactaataacgacatcaggcgtatagccgactacccactggtctccagataaattggggttaaaatctgtttcggttgttccagttttacctgccattgtataaccataaacattggcattaatagctgtaccatttgagaatgttcctaacatcatactagtcattttactagccactgagcgactaataactcgcttaggcttatctgtaaattgctttactaattttccattagctgtctcaattcgagtaatcaaatgagcgcgatgcattataccgtcatttgcaaaagttgagtaagcttgtgccatttctaaaggattagtggttacacttccacctagcgccactcctagctctttgtttgctgatgacatatttagaccaaacttcctgccataagtaaaggctttattgattcctagtttgtctaaagtataaacagcaggaatattataagaattagctagtgcttgatacatcgggatactttcagtctcaatcccaccatagttacttggtttataaccatgaaaatcttgaactttattaggaagttctttatctattgaccatcctgaagcaatagctggtgaataaacaactaaaggttttatggttgaggctggacttctctttgattgagtcgcgtagttaaaacttctaaactgtgcatctttagtactttgaacacgtccaactaaacctcttacaccaccagtttttggatctaaagctacgctagcaccttgggcagattgaccatcatagtcagatacagggaagaggctagtatcatcaaatgttttttgcattcctgattgataattttgatctaatgcagtgtaaatcttatagccattattgacaatatctttttctgaaataccataagtatcaatggcttcattgacaacagcatcaaaataggatgggtacctgtaatcattaattttaccagcataggtatctgctaatctatttttcataccaattgaagcagcttctttagcttgagacttggttagtttacctgcatcaaccatcgctgccaaaacagtatctcttcggttagttgcattttcaacagaataataaggattataaacttctggtcctttaagcattccagcaagtgtagcagcctcatctactgtcaaattagcagcactggttccaaaatatttcctactagcatcttccacaccccaaacaccattaccaaaataagagttattaagatacatggtcagaatctcagccttgctatatttcttagtcaattctagcgctaaaaagaattcacgcgccttgcgtttaatcgtttggtcctgtgacaagtaagcattttttgctaattgctgggtaatagttgagcctccgccaaatttcccaagtgtagctactgccaaaaaaaatcgcttaaagtttacaccattattttcataaaaagttctatcttcagttgctataacagcatttttgagatgatcagaaatagcatttaactctacataagttcccttttgtcccgaaagttttccagcatattctttattcttatcataaatggtggtggttgtttttagagcactctgtaaatcactaactgtagcagttttagaaagataaaaaagatagctaccaaatataagaataaaagccattaaggcgataaaaagcaacttcccaatacgatagcgccgccaaaaacgacggataggatttttaggagaagggaggtaacgatcaactttttgtagccattcaggtcgagatttagcattttccttttggtgacgaatgcctcgctgatactgggatttactaggtcgggtaatatcatcaatatcatagacttcttcgccatccaaattgctagtttcttctctagtttcttgttcattttttcttgtcatttcgtcgttgtcttcatcaacacgaaataagtctataaacttatcaaataatttcatagacttattatatcaattttcaataaaatgctataataaaaccatgtcattttcattaaaaattagaaatccatacggtgaacataccgttaaagaactccttgaagattattttttgattccacgtaagattagacattttttgcgtgttaaaaaacatgtacttataaacaatgaatttattaattggcaaactgtcgtccaagaaaacgatactattaccttaatctttgatgatgaggattaccctactaaaaaaattcctctgggcagagcagagcttattgattgtctttatgaggatgaacatcttattatcgttaataaacctgaaggtatgaaaactcacggtaaccaaccaaatgaaatagcactgttaaatcatgtatctgcctattctggacaaacatgctatgttgttcatcgcctagatatggagaccagtggagctgttttatttgctaaaaatccatttatacttccccttatcaatcaacgcttagaacgaaaagaaatttggcgtgaatattgggctttagttgaaggaaaattttcacctaagcatcaagttttgagagacaaaattggacggaaccgtcatgacagacgtaaacgaatcattgattctaaaaacggtcaacatgctatgacaatcattgacgttttgaagtatatccaaaatagtagtctcataaaatgccgactggaaaccggaagaacccatcaaattcgcgttcacttatctcatcatggacatcccttaataggagaccccctctacaacccttcttctaataatgaaaggttaatgctacacgctcaccgattgactctatctcatccattaacttgcgaaactattagcgtagaggccccttcatctactttcgagaagattttaaacaattataaaaaaggagttggataataattatccaactccttttaatcattattgcttagttaatggcttactgagtagtggtttatggtaatcaaattctccatcactagatgtctgccagatcactgggatgatcttattcccttcaatttttattccataggcgtatttaactttaagaccaccgatacctcctgttacaaaagttgtagtatcagtacctgattcatattgataaaggtagagcccatttcccttatcctccaacttcgtaactttagcagaatggttactttccttagatttactatccttgtaaacttttttctgagtaactttaccatccttatcaaaagtcatcgttactgtaccgtcctcaacttcacctttccaacttcctacaaggttctctggaaaaatggaaacgggatcagccttaactttattagtttccttagctactgtgatatcttttttaccatcattagaaataaggtaactatttcccgattttttcataataaaattaccagttaaattctgaataatgtggccatatgttttcttatcaggatctgttgatttatcataattaaaatcataatcggcagcaaaattaacttgataactttctttcccaacctgtgtcattttattaaggacaatattaggaatagtgaaatggctcgctttacgattatcagttacaaattttgctttaatactttctttcaatcctttgtaaaaatcattttcggcacctttttcaaaaactgttcctaaagtctgagggtcttgcccagttgatacataaagtatcaattgattgaaagcagttatcaatttctgtccagcttctttttcatttaataaaccatcaacatctaatttgattgtctgattatcagcgatagagattaatttttgtttatgagaggttatctcaccatcattaaaaacttttttgatataagcttttgaaccatcagtcactggataattctctacggaatggctaccatcttttaatttagcaatacgattatcaccaaaataaagattaccatccataagattacttgttactgtaaaagatttaaaagcgaccgataaatcaatagtttggtttttaccatcataatcttttttgagtttaatctcttttccgtcactagtcccttcaaggctagcagtataatgggttctaggtaaacgttccaccgttactgaaaaatgatctgaattgcttgtcgcgacctttttttgattcaacaaaacatccaatttaggaacattggttttcaaggtcaaagacataggcttattagcaatacgataatcagggaatatacctaagcgactacctacacgctttagatacattgaatcatttttgtttccttcttttatttcctgccctaatttacgcgcctcacttttagacaagggctcaaaattagcgtaattggcctcatcatttgtgatagattctcccgtatctgaccaaaccatgtattctttaatattatcaaacgcttgacctgacgtacgagaacgtgctgctacaaaacgactaagtacttgtccctttgaaaaataaaagaatcctagactcagaagtgatactaaaactataccaaaaataactaagcacactttaacaacttttttcttaaaaaaatcaaacataccttatcctctcattcactttatattaaagtaaattgcttaaagaaaagttacaacactgataaaacagctgtatttgtacttgtaaccgctatttttctattataacaaaacgaaaaaaggattgaaaccataatccgatttcaacctctaaaatttttgtctatgattatactaagtcctgcaagaagctttctccaatcatcgcagtatcaacaccaaagttatccgcaactgttgctgaaatatctgcgaaatgccctactgggataagtccgtttcctgtgaaggatgggctataggctaagagaggaatgtattctcttgtatggtctgtacctgcataagttgggtcattaccatgatcggcagtgatcaaaagtaagtctttgtcacgcattgctgaaatgatctctggaagacgctcatcaaactcatgaagacaatcacgataaccatgaggatcacgacggtgaccatagagagcatcaaagtcaaccaaattagtaaaggagaagcctttttcaaactctgataaccccattgtttttatcaaagtatcaataccatgactatttgatttgttatgtcccatatcatgattaatgcctgaaccattgaaaatatcattgattttaccaacagcataagtatcgatgccagcttgatctagtttatttaatacggtatcttcaaatggtgatactgcatagtcgtgacggttggctgtacgcgtaaagttacctggttcacctacatatggacgagcgataatacgaccaaggagagctggacgctccattgtgatactacgagcatattcacaaatccggtagagttcttctagagggatgatatcctcatgagctgcaatttgtaggactgggtcagctgaggtatagataatgagctcaccagtttccatttggcgtggtccaaagtcatcaataacagctgtccctgaataaggtttattcgcttcacgaataactttacgtcctgaaaaatcctcaatctttgtgataatatcttctggaaaaccattccagaaagtatcaaatggctctgtaatatttaagcccatgatctcccaatgccctgtcattgtatctttaccaagtgatacttcttgtaacttcgtcgcgtagccacttggattttcttctgcagggacggtcttaagcgcttggggacgaggaatattaccaagtccaattttagccatgtttggcaccgcaagtccaactgtttttgaaatgtggccaagcgtgtctgaagcaccatcaggaactcctgcattgacaaaatcattggcatctggtgccgctccaatacccactgaatctaagacaactaagtgaatgcgatcaaattgtgacataacttctcctttatcaattgaaaataggaagtcagaccagcatccttcctatttcctttatattatttaataagtgccttcttcaactttttggttcttaacaatcttgatgatacggctagtacccaagcgtgaagctcctaaagcaataaatttttcagcatcttccaatgatgagattccacctgctgccttaattttaacaccttcgccgacatattttgccatcacttcaacatcttcaaatgtagcacctgctgtcgaaaaaccagtagaggttttaataaagtctgcacctgaacgtgtgacaaccccacaaagttcgataagttcttctttagttaattgacatgtctcaacgataacttttaagatatggtcttgacatgcagccttgatttgacgaatttcttcttcaacagtatcaaaatccccatttttaacatctgtcaaattaatgaccatgtcaatttcatcagcaccatttttaatagcatcttgacattcaaaaaccttcgctgcagttgtactatagccatttgggaacccaataacagtacaaatagctaatttacctgaaacgtactctgctgcttttttgacgtaagaggctggaatacatgctgaagctgtttcataagccattgcatcatctaaaattgtttggatttctggccatgttgctgttgttgctagcaaagtatggtctaccgtttttaaaatatcttttacttccacgttactatccttctttcttttgtcaacttttagaatagagttacaataccgacgataaaggcgctaagcatacttacagcaataccaccaatcattgcacggaaaacaagtcgagctagggtgccacgtttctctggacaaagaacagcaatacctgaaacacaaatacctaaacttgataaattagcaaaaccacaaagtgaaatagttgctaccaatgctgtacgataatctaaagatttgattaggtcacccaattgttggaacgaaacaaactcatttaaaatcaacttacttccaagaaggtttccttctagaagaatgtttttgtggtcaaatcccataagaaaaccaaatggagcaaaaacatatgagaagatttgttctaagcggattcccaatccacttaacatcatattaatcaaagaaactaaaccaacaaaggcaatcaaactagcaccaattgagaaagccatttgtgcacctgtgcttgcaccctcagcgattgcatcaatcacattggcgttattacctttattatccatcttaatgtcatcaattttttgaacaggttctgtttgaggcaataagattttagcaatgagaatactgccaataggaaccattgttgaagcaatcaagagatattccattggaatgcctaatgcaatgtagccaccaagaatagaaactgacatacttcccatacctgataccaacacaaccattatctcactatcagtcatacgacctaggtatttgctaaccaaaattggactgtctgtttgaccaagaaacatattagctacggcaacaaaactctcaacctctgaggatttcataattttaccaacgcccttacctatccattttactacaaatccaaggattcctacataataaagtagactaactagggcagataagaaaacaatattgccaagcgtttgaatggcgaaaataaaaccagtttttgctccactatctgctaatgaaccaaacacaaaatttaatccagcttgaccacagttgattactttagtaactccagttgaaacaacactaacaacttgttgacctagtgggatacgtactaagattagcgcaataatgaattgaacgataagagcttttccaattaaacttagagaaacactcttacgattgaaagaaattgcatacacaattcctaataccaataaaataccaataatactataaataaattgcatgatgacttccaaaacctcgcttattgtgatttatcattttcaataagtgtgcggagtgcttcaacagcaacttgaatagctgcttctgtgtcatgagccattgggttatccatacccaaagcgttgcgttcttgattaccaacaacaaggaaatctgatccacaacgaactcctagatgacttgctgctacaaaaagagctgcagattccatttcagacgcttttgttcccagacgtttccatgcttcccatttatttaataattcataactaactggcatacgttctggctcatgttgtccataaaatgcatctttacattgaactactcctgcgtgacttgtgtaaccaagctttttagctgcattaactagagcattcgttacctccaagtcagctacagcaggaaattcaatcggagcatattctttacttgtaccttccatacggatagctccagttgcaataacgatgtctccgcctttaacatcaaggtcaataccaccacatgttccaacacggataaaggtatcagcgccacagagtttcaattcttccatcgcaatagacgctgatggaccaccaataccagttgaagtaacactgactttttcaccgtttaatgtacctgtataagtaacatattcacggctgtctgctacaagaactgcattatcaaaatgttctgcaatttttgcacaacgttttggatcacctggcatgataacataacgacctacatcacctggacgaatctgtaggtgatattgcaatccgacttcacctgaataattctgcatgataaagacctccttaatgtcttgtctatttttttacacttgtataataacatacaagacaacctttgtaaacgcttttatcgaaagaaaacgttttattttttaacttgatttttctaattttttcaattaaactaacttgtatacggaggttacaatgcctaaaaatgaactaaataataaactaaataaactaaagcatgtacaagtctacaataagatttttaacatgattcaagacggtacttattctcctggaatgcaattaccttctgaacccgaattagcagggcaacttaatgttagtcgagctactttacgaaagtcattagcactattacaagaagaccatttggttaaaaatatcagaggaaaaggtaatttcattagagaaaattctagcaacttgtctgaaaacggttacgaaaatagacaacaccctattaaaacttgtctaacttccaaaattacagaagtagaattagaatttcgtgtagaggttcctgcagaagctatcacagcttcacttaaacaagaaacccctgtagttgttattgctgatcgttggtaccacaccgatgatggaccattagcttacacactttcttttatccctatcgaacttatttcagatgctgagatttctttacatgatactaaacagttgttaaacttcattgaagaaggtatctatcaagaaggcatatcaagccactcacaaagccatttgggatatgcgacatctggcaatttttcagcaactaaatataccctatccgatcatggacaattcatattaatacaagaaacaatttttaagcaagagaaaatactaatgtgtaataagcattacgttcccattgagcactttgaattgtccattacctctcattaaggaggcaagcctatgcaaaatagactattaaaagttgcttttttcataacttttaccgaattaattatgggcctaatagttggcgcttattttaagttaagttattttctagcccctccaaaggaaccgtcaatgggtgctgggtacggaatgctcttttctctgttatttatacttattagttacttaattctattagctataattcaattcttagcttatcaatctcaatctaagataatagcaatcattgttttgctacttttttcctcccactactggcaaatattagatggcctatccttatgatcttcttaccgcaagtggtagtgactatcatatctctattatcacaacataaaactcccctttgttaaaggggagttttatgttgtgataagttagtgattagaagccacccatcatagatggatccattgcaggagctgtaggagcttctggttcaggtttatttgctactactgcttctgtagtcaagataagacttgctacagatgccgcattttgaagtgcagaacgtgttactttgacagggtcaatgatacctgtggtaaccatatctacccattctccattggccgcattaaatcctgtaccaatttcagactgttttaaacgttcaataataactgaaccttcatatccagcattgtaagcaatttgacgaacaggctcttcgagagcacgaagaacaatattacgtccagtctcctcatcaccattaagtttcagtgccgctactttttcaataacgttcacaagagccgtacctccacctgaaacaataccttcttcaactgcagcacgcgttgcatttaacgcatcttcgatgcgaagtttcatctcttttaattctgtttcagtcgctgcaccaactttaattactgctacaccaccggctaacttagcaagtcgttcttgtaatttttcacgatcaaaatcagaagttgtagcctccatctgtgacttaatgatagctacgcgattagcaattgctgatgagtcaccggcaccttcgacaataacagtagaatctttatctactgttactttagcagactgtcctaaaacttgcatagtagcatcttttaagtctaaaccaaggtcttcagtaacgacagttcctcctgttaggatagcaatatcttccagcatggctttacgacgatcaccaaatccaggcgctttaacagctacgacattgaaagttccacgaattttgttaagaacaagcgttgggagagcttctccatcaacatcatcagcgatgattagcaacggacgatttgttttaagaacctcttctaataatggtaaaatttcttggatatttgaaattttcttatctgtaataaggatatacggattctcaagttcagagaccattttctcgttatcagttaccatatactgtgacaagtacccacggtcaaactgcattccttccacaacttcaagctctgtttccatacctcgcgattcttcaatagtgataacaccatcattacccacgcgctccatagcttcagaaatgtattccccaactttttcagaacgtgaagacacagccgcaacttgagcaatagcttctttgcctgaaactggttgtgcaatctcttttagctcttcaactgctgctgaaacagctgtttcaataccacgacgaatgccaatcggatttgcccctgcagttacatttttaagaccttcccgtacaatagcttgggtcaaaacagtagcagttgtagtgccatcccctgcaatatcattagtttttgaagccacttctgacacaagtttagctcccatattttcaaagtgatcttctagctcaatttctttagcaattgtcacaccatcatttgtaattaaaggagaaccaaatgctttttcaagaacaacattacggcctttaggacctaatgttactttgactgtatcagctaaaatatcaacaccacgcaccattgctgagcgggcatctgctgaaaatttaatatcttttgccataatttaatacccaggcctaaaatttaacaaagtctactttctttacaaagcaacttttctctaataggcctatatcctttcttgcttaataaaacctatttaacgacagcaacaatgtcactttcgcgaacaactgtcactttttcgttaccgtctttaacttccagaccagcaccattttcgactaaaacagtatcaccctctgcaacgctcggtgcaactaattcccctgttaaggtacgaataccgtcacccacagcaagaactttggctgtctttgtcgcatcatggcttgctcctgcaagaacaaaaccaccgacagatttctcttcagtttcaacaaacgaaatgatcacacgatcacctaatggttttaacataataaacgaacctccatacgagatatattttgattttttagcactcttatacagagagtgctaactacaaaaactattctatcacttggtcagaattagtcaagagaaaaggcacgtttcaaacaagaaaaatttccctagttatcctgtccattcactagagaaatttatattttaacctaagacaagggcatcatctatcaactgttgacctgagtttttatggaaaagttccattaattctgcaactgttaagtttctctttgcttctcctttaacatcaacaacaattttcccgtggtagagcatcacgagacgattaccataagcaatggcatgctccatattgtgcgtaatcattaaggctgtcaatcgttgttcttctatcactttctgtgttaattccataaccatatcgctagttttgggatctagagccgctgtatgttcatccagtaataataatttgggacgaacaagagttgccatagctaacgtgagggcttgacgctgaccgccagataaaaatgcagcatcagtcttcattcgattttctaagcctagacctaattgtgatagagactttttaaatagttgacggtcatcgtcagtcactgactgtctaaaaatgtgacgcttattgcctcttttatgtgcaattgccatattttcttcaatcgtcaaatttgttgcagttcccattctaggatcctggaagactcgactaatatccttagatcgtttttctacagagtctttagtaattgattggttgtctaatgtgattgccccctgatcaatagggatcagaccagcgatacagttaaggagggttgattttcccgcaccgttacctccaattactgaaataaaatcaccgtcttcaatcgttaaatctaaaccacgtaaaacatggttctcattgacagttcctttttcaaaagttttgtgcagattgactaattcaagtaatgacatgttcttatccttcctttgtaagtgatttagaggtttttactcctagtttagctcgtaattctgggacatacaaaatgagagccaacaaaattgctgaaaccaactttatcatctgtgcatcaatatcggttgttaatatgaaaacaataatcatacggtataaaacagaccctaatacaattgaccataaccttttgccaagaggtaagtattttatcattacttctgccaagataattgaagctaatccaataacgattgtacccactcccatattcaaatctgcatagccattattttgcgctaaaagtgcaccagataaagcaatcaggccattcccaatcatatatcctagcattttcatccgatctactttaatactattggcttgtcccatagcctcattatcacctgtcgctcttaaagctaatcctagttgggtatttaaaaagagatacaaaattaagataaccaagcctacacaaacaattccaattaataaaactgctgaaagtttatttaaacctaatcttgttaccattgtaaccaaagtatttttgagagcaaaagagacgtttgatcttcctaaaacaagtaaattaatagagtaaagtcctgtcaacgtaataatacctgtgaggagggctggtattttcattttagtatgaagaaaacccgatactagtcctgccaacataccacctaacatgcccgctatggttgccacaattggattaatatcattaacgatacataaagcgcaaactgcagcccccatagggaaagcaccctctgcagagagatcggctatgtctaagatacgaaaagtgataaacacgccaattgccataattgaccaaagtaatccttgcgaaattccggataagataatatctaacatacaatacctttctgattatttattatttttaatacttgaaacatcaattccaagctcttttgccatatcttcattaactactacttttagattttgaggatattctgaaggaactttagcgacgtctttacctttgaggattttaacagcttgtcttgccgtttgacgacctaaagcctcataatcagccccataagaaaagagcaaaccacttggtaccatatctgctgaacctcccacaacaggcacttttaattctttcgatagattccctaacagcgttactgagctggctataatattatctgttggtacaaaaataacctctgttttagacattaaactcttagcagtatcttgtacatcattagtggaagaaatacctttaacacttgttttaatccccgcctcttggaagattttttttgcttgttttacctgaacttctgagttacgctcgctagtggtatacataataccaacacgtttaaccttaggcattacttttctcaaaagggatacttgctttttaattggagacatgtcacttgtaccagtcgctaaaccttcaggttttttcattgattttactaattcggctgataccggatctgtcactgctgtaaataaaataggtgtttctgttgacaccgttgtcaacgattgagccgccggagtcgcaattcccaatactaatttattatctttaatgagtttttcagaaattgattggatatttgactgatccccttgagcattcttatactcaattttgatatttttgccatctttatagccttctttagctaattcttttataaatcctttcctagtggcagttagagagggatgttctacatattgtaaaataccaatatgttttacatcagattgaccattttgagaagattgtgaacaagctgtcatcagaacagttgctaaaacgctgctaattaccatctttgttatttttttcattactatctccttgtaataccatcaaattttccataaaacaaaaaaccaactagaccctacatctagttggttaattatttctctcaattcctctgtgcacgggagggcgaaaaaatattgccttaaccaactagattattgaaatgatctaatcggctctgctttcatcataaaatgctttagcttcatagatacaaactttgcgtgacgtttgtatccttgaggctacaaacgtctatctaaagaaactaaagtaataataagtatttgtttgtttaataatagacgatttgattaacatattattctctccttgtttatggttgcctataagtttacgtcatttaaaaataattgtcaatagttaaatttgatttttttgaaaattcttgttagatagataatttaaataatagtcattcgttgatataacacgcttttaaggaaatttagatttgctatccttaattttccatatactctactaaagcataataaataccatcgttatcattatcctgagttacatttccaattctctcttgtaaatctttaggagcattccccatgacaaaacctttacccacaatttcaagcagatttaaatcattatagttatcaccaaacgcaatagagtctgcaagagaaatatctaaatagtctgctaaagttttagcagattttcctttttcaatacctggagccattatttcaataaagtaaggagcagattgtgcgattgataaatgtggatattgagctttcaaagtgttctccaattctcccatcagagatggttctcccatcaagagaagtttatgaatcctatcttgcttctctaactccatcaaactcatctctttagattgtaaaccaacaatctcctcctctttttggacccactcattttctttatcacaggaataccattcatgataacgatagacattccatgcaattttcgaataatgcttgcttacataagaacaaacttgtaaggcaacttgaccatccattgtgtgggaagcaattgttttttgttgcatatcttgtattaaagccccattataggaaataatataagaatctattccaatttgttccataatcggagtaattgcctcaggcatcctagctgatatgggaacgaaagtagccccttgagctactatttgtttaattccctgccgtgtcttaggtgttactttaaaattactgttaattaaagtaccatcaatatcactaaatattagccttaccatattatcctccaaaatataattgtacacgcttactttagtctaacacttaaatttttgtttcgcaaataaacttcgtctggtctaatgagactactaatataagctatatttcaaaacaaattagtttatttctctcaatgaacggtgtaatatgttactatatagtaataataggaggattaactatgtcgtatccatacaaagccaatcattccattgaatcaatcaccttaaaagtaaatgacctcgaaaacctcgtaaacttctatagcgatatcattgggttaactgttattgacaaatcaagcactagagccttactaggggtaaatcaaaaaatccctcttattatccttgaaaaaactgaacttgaaaagcatagtacctatggcctttatcacactgctattttagtaccagatgaataccatctcagtctagctctaaatcatttattatctcagcatatccctctagagggtggagctgaccatggctatagcaatgctatctatctaagtgatcctgaaggtaatggaattgaaatttataatgataaggatatctctatgtgggatatcagagagagtggacaaattattggtattactgaaagactagatattgacaatttacttgacagccttgtcaacgttcctaataattataagctttctgaaaaaactagtattggtcatattcatttgagtgttaaagatgctaagattagctcaaaactctatcaaaatgtttttggccttgatgagaaatttgcaatcccgacagctagttggattgcatccggcaactaccatcatcatctagcctttaataattgggctggtccaaatctttctaaaaaccaagaagatagacccggaatttccttattgacaattgcttacaatgatgacaacctttttagagatagcttaaaaaaagcgcaactttaccaactgactttccttgaaaaacaagatcattattatattattgaagattttgatggcatccgaattaaagttgttctaaaaccagagaattaaccatcacttgacttttgcctcttcattttacataatgtcaatatgataaaaattttgatcccaactgcaaaagaaatgaaagtgtgtcaaaacattgcatggcctaaactgagtgctcaaacgaaaattataattgattatttttctactttaactgtttcagacttagaggatatctacagaattaatacaagtgcagctcgttgtgaggctcaaagatggcaagattttaaagctaaacaacttactctgaatcctgctattaagttattcaacggtcttatgtaccgcaatatcaaaaggcacaacttatccacaagtgaagcacaatttatggaaaattctgtttttattactagtgctctttatggcatcattcctgctatgacactaatatcccctcatcgtttagattttaacactaaaatcaaaatcaacaataactctcttaaagttttttggcgtgaaaattacgatacttttatgcagtcagatgacattatggtttctttgctttctaatgaatttgaaactgtcttttctcctaaagagcgtcaaaaactaatacatcttaactttattgaagatcgagatggccaattaaaaacccactctaccatatcaaaaaaagcaagaggaaagtgtttaactgctatgatggaaaataattgccaaactctagaacacttaaagcaattacgctttgatggcttctgttatgataatgaactctcagactctaagcaattaacttttgttaaaaaacagacttaagtaactatttatccacaatttattcacacaaaaagcaagagataatcgtatctcttgctttttgacaaacttgtaaggtctaaaaacctctctatatcaaggtttcaaacaatattaacaaaaaataattgttattaacaacttgtggataactatggggatagacagaggataatctgtttatataaagttgattacttaacactaatgtcattgtatatacctttagatttcaaaaatacttgttaaattaacaataataaacgtcaacatcttgtcacagactgtcaaatacttataaacaagttgtggataaacataacttttaatttttatttaaaagttaatttttgacactagagtaaatcatctcgtttgacttgttcataactattgtcaccatcgtttaatccttcccaaatcacgacttcaccttcttttaaagatttttgtacatcaatgattctttgatttgaagatcctctaaattgtagcattaaatttcgcttactttgatcaaacctaccatccactaaaatatcaatcaaagataacatctccaatttatcttgagtctccagcatcatttcttcccaagtataccccgtccatgaccaaatatctttttctggcaattcacgtcggatacgctgaagaagtggcaacaaaatacctgtatttaagaacggctctccacctaataacgttaaaccttggacgtaaggttgttctaaatctgtcataatttgatcttcaagctcttttgtataagggattccggctcgaaaggaccatgtagcagtattataacaccctttacagtggaacatacatccagctacgtagagtgagtttctaacaccttcaccatctacaaaattaaaagctttataatcaatgatatggccatgacttaattcttcgcttttccactccccaggctttggagtattccaacttgcttcttctgacatttctaacctctctattgatatgaaaagaaccagaactaactggtctttttattattatcttaaagtactattttaggttatccaataacgctctgtctgatgaagacaatcttctaaaacaccaccgttagctaatattactgacttgctggcatcattgtctacatggcatgtcacaagtatttcattaatattttttagatgtgcttgctcaattcctagcttcaactgttctttagcataacctttgccacgctggcgaggtcgtatggaataaccaatatgtccacctttttctaaaagagtatcatttagtcttaaacgtaaatttaagaaacctatagcattattgtcattgtcaaaagacacaaactgaatatatggaacaaaattatcaggaacgcctacccctaactccatatttaggttatgatctagccagtcttcaaaatgcatagttggttcataaaaaccaccgtccactgaactactttctttttgaaactctttatacatggctaaaatttcttctttatcttctaacactgggcgccgtaatttcatattgtttcctattccattatcttcaagttaagcattccaaaaggagcattcgctttattaatctggtcacaaataaaatgactcaataaactagactttggtgatataggattgacacctgtagtgatagcttgaataaaagcatcaatcattggttcaaaaccacgtttctctagagtgcttgcccaagaaccaaaaccgatagcacgacggtcaaagccatcaataacagaaagatttgacaaatcatctaatgaataggttacttctggcgactctatttcaattatttctcgacgagaccccgactgcaggttcatgcttgcttctattatctcactgtctgtttctagcgttactgatacttgtaatatcttattcccatcacgtttagtcacaaagtatcctcttttaacaacattatttgtcaaaaatagcgccgtatctaaaggatggataaacatatcaaaaagcttatattgaaaatccgctggtgcattgacagcatttttaaaggtgcgaatatggtttttatcttctacttttttcatttccataatacgtggtgcaaagcgacgattaaaacctgccattaaaaatgttttatgatccttcgccaaatcatacaatgctttagttgaagtataatcttctgtcaaaggcttatccataaaaactggaatacccttttttaaaaaaagctttgctatatcaaagtgagcactagtcgcgacatgaatgaagactccatccaaaggatgctcggctagactatctaaactgtcataagctgtagaagaaccaaaaagcatattaacttcttctaaaatctgtttttggcgtgtaaaaagatgccagtgcacacctgtcacttgacgcatataaggtagataagctttctgtgaaatacctcctaaaccgacaattccaagttgcaacatagcatcctccttctattttttctttgccttttccaaaaattgtttccttaaatcttttagacgtgatttttgattagcattctctccagtagagtgcttctcatggaacttctgtacttgtgcttgccctttgtaatctaattggtatttccccatatcttaataactccttctattttatcttcttattttaacatataatagaccagaggttttaatagaggttttaattaattaccttgatttttaatacttgatccgttcatatgttttacacgagcagagatttccttatgacgaccattaaccatcggacgagcctgtggattacctaaataaccacatgtacgtttgacaacatctactgtcttagggtcgctgttaccacaatttggacaagtaaaacctcgatctgtcggtgtaaaatccccttcaaattgacattggtaacacttatcaatcggtgtattagtacctagataacctacccgatcataagcatagtcccaaactgcttctaaagcttttggattctgttgcaaaacagggtattcacagtagtgaataaatcctcctgatgcacccgtttcaggatagattttctcaaaatctagtttttcaaaaggtgttggattcttacgcacatcataatggaatgaattagtgtagtattccttatcagtaatatcagttactataccaaatttttcagtatctaaacgacaaaaccggtcagtcaagctctccgatggtgtcgaataaactgaaaaatgataatcatactcatcagaccaatctgcacataactgcttcatcttacgaacgatgtctacagtaaatgctttagcttgatggttatcttcccagtcaccaccataaaaaacactcgccacctcatataaaccaatataaccaagagacaccgttgcacggcggtgattaaagagtcgatcaacattgtcatattttcctaaacgttctccaaatgctccatactggtaaagaatgggcgcatttgctgggatagcctctttgacacgttccacacgataaaccaaggcatctctagcaatactcatacgttcattaaatatctcccagaatttatccatatcaccgttagactccatggcaacacgcggtagattaactgttacaactccaagattcatacgaccagatgttacatcctgaccatttgcatctcgccacccttgtaggaaagaacgacagcccataggggctttaaaagagcccgttaagtcaataattttatcataagaaaggacatctggatacatccgttttgtcgcacactctaatgctaattgtttaatatcataattggggctatcttcttctaaattaagaccttttttaagcgtaaaaattaattttggaaaaatagcagtacgatgctcgcttcctaaaccttgaatccgaattttcaaaatcgctttttgaatttctcgttcaaaccaattagttcctaatccaaaaccaagcgaagtaaatggcgtttgcccatttgaagtaaataaagtattaatttcatactccaaagattgcatggcatcatatatatctttttgtgttttagcgcgcgcatagtcttcttgtttatcttcaataacccattcttttgcatcttttaaatgtttttgataatttaactgtgcataaggagctaaaaactcatcaatgcgatctgctgtacagccaccatattgacttgaagcaacgttcgcaataatctgtgaaatctgagcagtcgctgtctgaatagattttggactctcaacttctgcattaccaatcttaaaaccatttgcaagcattcccttaaaatcgattaaacagcaatttgtcatgggagtgtatgggctgtaatctaaatcatgataatggatatcacccttttgatgtgcatttgctacatgagaaggtaacattttcagaccaattgatttccctacaatacctgctgttaaatcacgttgggtattaaacacatcagagtctttattagcattctcattaacaacagtttgatccttattaattaattttccaatagaaaaattgatatctgtagcctgtgaacgctcaaaatcgcgttgggtacgataattgatatattcttgtgcaatagcgtactcattagcttccaataatttatgttcaacgatattttgtatttcatatatcttgatgttatctttaaaacgattgtagatctcagcgatgacatgatctgcaatcatctcaagtttagcctcaactaaaggagacattttgataactttattactagcttttaatagagccgtgtagattttatacttatcaaagctgaccaaacgcccgtcacgtttaatcactttgatatcagattctgtcataaatcgttctctttccaataccatcatgtgaaatatcctccagtgacaattatagcatgcaaagaaaaaaaatcaatatattgtgtcaagttttttgctcagacacaatatattgattttttaatctatttgaaacgatatagaacaaaatgagtgatatttgatagaggaacttcttggtagtgcttcttaatatcagatttcagttcatttggtaacttctcatttttatttaagataaagtatttagccccatgctgaagcagctcgtccttcaaaattttctcattatttttttgcgctgtattaatatgtggcaaaacaaattgagaagcagattttaaccgagtctggctataaatgctagcaactttgtcccaaacataaatcttaccatctctatcaatttttgtagtcaaataatgtgaaatgtcacgcctttctttactaagagtaacattttgataagtattataaactagtaaccctatcgataaggaaactagtaagaggggcaaataatatgttttctttacaaaaaggtctacgataagagatttaccagagaaatactgacgtctatgtgaacgtctgtcaatcactttttggtaaagaatagtaattttattactcgttagcaaaagaccaaatggtaaagcaggtaaaaagtggtaaaggttaaaatctcttgaaaaaatggccattatagcgtaaataataaaaatacaggcaataaagttcaagccgatttgataagatgcttttttacgattttgaataaaatcccatagtccaaagagacaacctgaccctagaaggacaacaatttgaattgctaaactaagaaggaatgagtggtttgtcctagcgaaatacgtaaaggggtaaaaaatagctttgtcaatataagaagagataatctgtagattaaacataaagtaaccaacagtataagcaattaaaatcataccaaaaacaacgcataaaaactgataaaatcctcgtagtgactgcttttgcttaatattggttgctgttaagagaacaaaagagcaaagccaaaaaatcagtgtttggggatctataaatagtgagaatgctgctaaaatgccataaaatataaatgcttcatcaacgatattatcgacacaaaatttaattaaaaaccatagcgaaatgagcataaaaggtaatgcccactgtattgggtacataccaccgaatcctaagacaatattcattatatagaaaatcaacgtcatgcctatcgagacaatttcactttgtgccacataataaactaatttataaaaataaattccagatacatagtaagcaataaactgtacaataagtaaccagatactagaccctaaaaggtaacttagagcaatcgttacatagtataaaaatcctcctgtagcaaaaacatcactataagggatctgtcctttggtcatcatcaaacctgtatagagattctgagtctgcaaaccatttgcaaaataagtcaataaaggatttgcaattgctaagagagttgacaaaacactatatagtaaaattgaaaatcgactagatttcttcattctgatagccgttcgtttactcattgatgggctatttttatagctcactccaattggtttttctaggttttctaccactatttttctcctcatatttacatactaccagtatatcagaaaaccttatttagtcaatttagccaacacttgaccgtaacgaataatatccctaaagtagtggtattttctagacatatattgtttgagaaattcttgttcttctagtgttagctgagtatctgacattaacatcacctccttttactacatcatcactattattattcgaaaaaaaaacgactgaacaattgctcaatcgcttcgatattattcttcatctagaaagctgttgaaaacttcctcaatcatgtcccattctgcatctgaatcttctggtataggctgaaggtctccttcagttccatcggcattttctgtaaatgagtaagcttgaatctcaatttcaccttgttcgtcttcttccgcacctgcaggaacgaggagaacatagtttttgccaaactcttcacgcccatcaatagttaatagaatttcaaaaagtgtttcgttcccattctcatctacaagagtgattacttcatgttgatgttcatggttatgatcgtggttatgattatgtgccattgtttctcctttttatgccgaatgcttaaaacatgcggtctaaataattttgtaagattagttgagctgctaatttatcgataactttcttacgcttaccacgactaatatcagcttgctcaactagcatacgctctgcttgaacagtcgttaaacgttcatcttgatattcaactggaagattgaataattcagtgattttatcgccatatgcctgactagcctctacacgaggaccacttgtattattcatatttttaggtagaccaactacaaatttatcaactttgtactcttttactaactctgctaagcggtcaaaaccaaaatttccagattcttcatcgatcttaatgatttcaagaccttgtgcagtgaaaccgagtggatcactaattgcaacgccgacagttttcgagccgacgtcaagtcccattattctcattacaaatctattccatttccttgtaaataataacgaacgagctcttctacaatctcatcacgttcatatttacgaatttgattgcgagcatcattgtaacgaggtacataagcagggtccccactcaatacgtaaccaacaatttgattgatgggattgtaacctttttcttctaatgaacgataaacagctgttaatgtttcactaatttctactttgttactatcatctaatctaaaacgaacagtttcatctgtaaatcccatacctacaccttctttcctttaattctttcacttattataacttaaataaagtatttgtacaagaaattgataaacactatattagaaaatcaaaaagggagcacaagaaaccaagaagtgattctttgatttctttactccctaccttataggtgatttttacaggttatcgtgtgactctcacttatgcttatctaaagctcaaagtgctgcacgaagacgagcttctgcattttcaacgttacgaatagagcgaggtagaaaagcacgaatatcatcttccttataacctacttgaagacgtttgtcatcaattagaattggactctttaaaatacgtggattttcttgaataagatcaataacttcatttacactcaactcctcaatattacaattgagcgccttagcataacgatttttagaagaaacgatactttcaataccactttcagtttttgttaatatttctaaaatttcatcacgtgttagtgattctttacctaggttttgttctttatatggaagttgatgagcatttagccaagtttttgcttttttacaacttgtgcaacttgaaatagtataaatcttaatcatgtgccttctcactttctatcccatgatagttatagtttaacatagtcacaaaaatcaaacatgggacttaagacctattttttatcaatttactaataaaaataaatagattttagggatttttaagcttatttttagtataaaaataagttccaaccactgtcagaacttattttagttacatttattcaagttcaagatgtatagttgctattttattcctcaatttcaatagcattgtccaaatctaaaacaagatcatcagcttcatttttttcttcaacgagctcagactgaactggcgaatcatcttcagtcattccaaagtgcacgcgcactttatggtcaatttcatcaaaaattgctggattatctgctaaatattttttggcattttcagaaccttgtccaattttctcaccattatatgagtaccatgcacctgctttttggataatatccaaatcactagcaattttaattaactcacccgtgcgagaaataccttcaccatacataatttcgacaaaagcttcacggaatggtggagcaactttatttttaacaactttgatttttgtctctttaccaacattatgatctttatgctcaccagttcccttgatttgagtattaccacgaacatctagacgaaccgatgaataaaatttcaaagcacgaccaccaggtgttgtttcagggttaccaaacataacgcctactttttcccttaactggttgataaaaattgcgattgtctttgtcttgttaatggatgctgacaatttacgcattgcttgactcatcatacgagcttgcaaaccaacgtggctgtcaccaatatcaccatcaatctcagcacgaggaacaagggctgcaactgaatcgacaacaactaaatcaactgcgcctgaatcaatcaatttacctgcaatttcaagaccttgctcacctgagtcaggttgagacaaaagtaactcatcaatattaactccaagagccgcagcataggctgggtcaagagcgtgctcagcatcaataaaggcagcaatcccaccttccttttgggcttgagctacggcatgaagggcaaccgttgttttaccagatgactctggtccataaatttcgacgatacgtcctttaggatatccacctgctcctaaagcgatatctaaagcaagagaacctgaactcattacttgaaccttttgttcagctcgctcacctaagcgcatcactgcgcccttaccaaaatctttttcaatatttttcaaagcatcatctaaggcttttcgacgttcatcaccgaatttcttagtaatttcttctgcttttttcgtttttttagccaatgtcttctccttatatttctatgaatctaggttgattcaaatttagaaatcgttctactaattataacaaatattatatctttaataaagccctacgcaccaagtcaaaagcatgtaaagtactgatatgacggacatctgagcgactcttccctccaatcgatactttaatagaagaaacgccttcaggggttgcaatcccaataaaaactgtacctgcagggtatccttccaactcatcaggaccagcaactcccgttaaaccgataccaaaatctgcttttaaaagttggcgagcttgctgagccattgcctcagctgtaaaatgactgacaactccatattcttgcaattttttcttagggatgccgagaagttgtgattttgcttccatactataggtcgtaaaaccaccattaaaaacttgcgaagcaccagaaaattctgctaactgagattgaaataaccctgctgttaagctctctgcggcagtaatcgttttattttgtactttcaataattctaaaacagtacgtgccatactattattatcaccataaccatataataaatcttttaatttacggttatctaatgtcttaagagcaagtatttctttttctaagctatctaatttaaagtcggcctcatcctgattttcagctttcgttgataaccttaaagttacctcaccaacctttgcatatggtgctatagttgggtctgtctgattcttaattatgtcttctaagattgtgactaactgactctcaccgataccaaagaatctcaatacacgtgaatataattttgtgccattatttgacaaaataggtactacctgctccataaccattggctttaattcactaggcggacctggtaaaaccatatattggactcccttagatgtaacgataccaccaacagctagaccagtaaggttttgtagaggtattgagccttcaaccaattgagcttgtcgttcattatttggcgttctagcaaactgaggacgacttgcaaaaaaaacgatccaattttcgactagctaataaatctactgttaatgatttacctaaaaatttagcaaaagtttgcttcgttaagtcatcctctgtagggccaagtccaccacataggataaccaattgactgcgctgactagctatatctaaaagcgataataaacgttcctcattgtctcctacagctgtctggaaataaatatcaattcccaattctgccattttctccgacaaaaattgtgcgtttgtattaacgatctgtcctgttaaaatttctgttcctacagcgataatttcagccctcacaacttcaccctcttatctattcgaaataatgactacattttagcaaaaaaagtagcaaaagtgctacttaaaacatatcacattgatattacttgaaatcacatatattttcatggtcattaaccatacccgcggcctgaataaaagaatagaggcaagttggaccaacaaatttaaaaccgcgtttttttaaatccttagataagcgttcggataaggtagtacttgcaggcacatcgttgtagttgttaactgagttaacctgtactttattatctacaaaagaccaaatgtagcgatcaaaacttccgaattctttctgaattaatataattgacctagcattttgtcgtgttgagaaaagttttagacgatgacgaataaccctaggattttgtaagattatctctaaatccgcatctgacattgcagctaccttttcaatattatagtgatgaaaaacttgtctgaactcctgacgtttatttaatactgtttcccaagataaacccgattgataagtttctaaacatagtaactcaaagagtacatgatcgtcatgaacagctctcccccactctttatcatggtaagctacatataatggattatctaaattcacccaagaacatcgtttcatgtgaaacctcattacttctaaattatttcatcaacatcttcaaactagatttgatgtattgctccacagtctcgttcgtaccttcaaaaaaggcttttacttttttcaattcagtcgccttataccccaacgctaacaaagcttccatagcttcttcaagattgctattctgctcagagctaaccttacgactagtcgcactctcaccagaagcttctacaaacttccctgacaaatcaaggatcatctgttgtgctgttttttttcctatctttggaaatttagtcaaatacttaatatcactattatcaatggcacttacgagaccttcattgtcatcgactgcaataattgctaaagcggtcgttggaccaattcctgatactgaaattaaattaagaaaaatttctttttcattttccgtatgaaagccaaataaaagatgtgcatcatcgcgaatgacttgatgtaagtagatggtaacttcttgattaacgtaacctgaaaaagagtagggatttgccacatatatcatgtatcccaatccagctgtttccacaacaataaatttagccgttattttactcaattttcctttaatataatcgtacattctattttcctatctcaatatttttcattttggtagcatataagattaaaaccagacctgctaacataaaaatggtcaatgttatttgaacacctatttttcctgtaaaatagctgagcgaaaccatggcacctgctaatacacttgcaacaggttgtgcgatagctaaaaatccagaatatgatccaatttttccctccaccatcatctccgcccttagaacctgactagctggaacataaatcatttcgccaaaggtgaaaaacgtcatggcaatcaaaatagctccaaaagtgtttagagaaatattaaaaagcattccaaaaccacaaatcaagctccctaatattagttgacgtttcaaaggccaattctctatgaatttatttatagttgtcattagtaagacaattaatagagtgtttgtaaagactgctaaactaagcattttagcacctgtgattgtatgtcctaaaatggacactacttcaaaattttgcttaagattgaccgagaaataattatcaacctggagccagacaacactggaaccaattgctcctaaagtataaacaacaaacgctttatccactaaaacctgactataatttttaaaagttcctaaaactcctttatcatgcttgaaggttccctcctgtggttttgtctcatcaaacttgaagtagaccacgaaacaacaaatcgctgaaataataagaagaactattaataattcaaaaaaatggtgatcatagaaaatcccagcaattccagaacctagcattacagcgatgttaaccaaccaataacctatagtgtaaacaaagcgacgattctgttcgttcgtcaaatcaatggtcatagcttcataggcagggaaataaaattggtgagctatttcaatgataaggatacctacaaaggtcaagtgtggcgtaatatgatttggaacatttgcagctatagttatagcccaaccaatggttgccagcagtgaacctataatcacaacttttttcctccccatagcatctgacaaatggcctccatataaggtcgctacaaaccctgatagttgagttatgatgatcaagattcctgtaactagatttccaaaatattgaacataatacattgccataaaaggaaaaatagctgaaccaaccgtaatggaaataaaacgcaataattctcttaactgtagctgttttggcaaagcaaaaaactctttcactttttctcccttcttccctaacaagtaattatcaatattttcctaaatccctgaggcttgtatgattttcttggattcgtttaaacattttctccatatcagcttttgtaaaattaactaaaacaggtcttccatgagggcaattataaggatttttacattgcgctaactgatctaataaatgacgtgctgagtaatcgtctagcgtatggtttgctttaatagatcgcttgcaagacatcataatagccaactctgcgcgatattttttcactgatacttcattagtgagcaacaacatatcacacatttcataaatgccagactctacctcttcttctttcatccaaattggatgttcccttaaaatgaaagtattattaccatacggttccaagaaaataccaacatcttgtaataatgacattttttcttgtaattgaagaaaatctgaacttgaaaattcaaatagaaatggtactaacaattgttgaagactattatcaacctcacctatcttttcacggtaatactcgtattttacacgctcttgagctgcatgttgatcaataatatacaacccaccattcccttgagcaaataagtaggtcccatgcatttgaccaaaaaattcgagctctggaaaagtcgaactttcttccgaatctaatttttcaacaagtttgttaagtgactgtttactactaaggtaatcctgagaatgaatgaagttctcactatcagcttgatctctactagcatactttatattaggagactgcgttgctccttgattaacagagttttttacatcattgtcaactgaaccgtcacttttgtcaaggtttgtaaagttagcaataggttcagatacagtatctgcacctataaaaaagtcatttttagccctatcgtaatacaaaccaggctgttttagtgagaagcttgtttgtataggcttatctacacttcgggtactagttttagctaaattctctaaagcatccggaatcaagtcatattgtttaagactctcagaaattgctgtgcttattaaactcattaattctcgttccttagaaattctcacctcttgcttagtcggatgaacgttgacatctgctagataaggatctatctgaatatcaatgacagcaattggaaatcttccaaccatcaactttgaaccataaccatctagaattgagcggttcaaaagaaaatttttaatgtaacgaccgttaattaatagggtaatatagtttcggttagctcgtgtcaattcaggcaaacttacataacccgaaatttcaaaatctaaatctgcatttgaaatctcaatcattttttttgcagtatttaaaccataaatacctgcaatcgcctgtctcaaatcgccagtcccactagttttagtcatttctttaccatcatttatcagtgtaaaagcaacttccggatgcgctagactgagtctattaacaatatcaataatatgagctagttcagactgtaaactcttcatgtatttcaatctggcaggcgtgttaaagaataaattttcaactaaaatttttgttccacgaggacttgaaacaacttcctgtttttcaatgtttccccctttagcaacaagtaacgtcccttgtttcccttgctctgtagctgtttttatcgtcattaaactaatcgaagcgattgatggtagagcttcaccacgaaaacctaaggtccgaatacgaaaaaggtcactctggcttttgattttggatgtagcgtgacgtcgtaaactgagaacggcatcctcactagtcatcccttcaccgttatccgttatttgaatctttttaagaccagattcttcaacctctatggtaatttggctacttcctgcatctatggcattttcaactaattctttaacgacgctactaggcctttcaacaacctcaccagcagcaatctggttagctaatatatccggtaattcaataattttagacaagttcatccctcctttttttatgattttttgtaactttttttgtgatatcttagccattataccatattcaaaatattaatttgacaataacacaatttttagttgacatcactcctattacctgttagacttagggagcgtaataagttttgaagttgtatttttgtttaacatttttaccttttttattttttacagtaacatttttagaaaggtaataaacaaatgacacaaggtacagtgaaatggtttaactcagaaaaaggttttggctttatttctagcgaaactggaacagacgtcttcgctcatttttcagagattaaagttgatggcttcaaaactcttgaagaaggacaaaaagtaacatttgatattcaagatggtcaacgtggaccacaagcaacaaatatcaatcttgttaaataattaaaaaagagcctaaatgaattatttagtctcttttttgttgcctaaaggctattttataataatttctttaagtcaaatatagcattcatagcttgcattggagttagattcattatatctatcgcttctaactcctcaataaccctacctgcatttgaaggttcttcaaaaagcgataattgtccttgttgcttctcagaatctagttcctcatttaagtcagcagtaacagcttcttgggagggcgatacgatcaactgtactgcatcagcttccaactgtgataaaatatcagttgccctatccaataagtcaattggtaaaccagctatttttgcgacgtgtatcccataagacttatccgcaggtccagattcaattttatgtaagaaggtaacttctccatctctctctaaagtagccacgtgtacattgacaagccttgtcaactgttcagataaatctgtcaactcatggtaatgagtcgcaaacattgtttttgccctaacacggtcatgaatatattctataatcgattgagctaatgccataccatcataagtggctgtccctcgacctaattcatcaaaaagaatcaaagatttatcactggctcgttttacagcttgattcgcttccatcatttctaccataaaggttgattgcccagaaattaagtcgtcagcagcaccaatcctagtaaatattgcatcaaatacaggcaaatcaacttcgtctgccgatacaaaacctcccatttgtgccataataactgtcaaagctaactggcgcatataggtcgacttaccactcatatttggtcctgtaatcaactggatatctgtctgactatcaaaatagatgctattgggaatatattcttgcactcccatcactttttcaacagttgcatgacgcccattcttaatcttaatctgatgttgatcattaaatttgggacgaacatagtgataattttctgcaactactgccaaactctgtagaacatcaacggttgcaatcgtctttgctaactcttgaagacgtttaatataagattctacttgggcacgaacacgcataaaaatatcatattctaaatttgaagattgctcgcgagcttcgagcatttcaccttcaattttggctagttcagctgttccatagcgttcagaattttttaatgtcgctttacggaaaaaatgctccggtactagtgataaattggaattggtaacatggaagtaataaccgtcttttttattataatcaattttaagagtaccgataccacttgctgctctttccttagcttcaatatcagcaatccaacctgtaccttcacgcatcactgttcgataattatccaattgcttatcaaatccagacttgataatgtttccctcagtgatagtagcctgtgcttctggggctatcgccgtattaattaaactttctaattcaggcatagtgtcaattttgttgacaatgatgtcaagctcaggttgattgaaggactgtaaaatcattttaatccgaggaatttgtgataaggtctgtccgagttgcaatagatctttagggttggcttttccgaaagatactcgacttgctaggcgttcaatatcatatacaccctttaaactttctgtgagatcgtttctctcaaaaaaataatcaagaaacacttgaataatatcttgacgttccttgattcgattcatacttaccaaaggcctgtcaatccaagttctcagcattcgagttcccatcgctgttttagtctcatctaacaaccagtaaagacttccatgcttcttgcttgttctagcattctccagtaaatctagactatttttcgttgcatatgacatttgtaaatagtcctttatttcataatgaactactttctgtaaatgactaagttcacgcttttgtgttctatgcacatattgtaaaagtttttccgcagcagatatttccaaatcagttaactgctcatcaatcaaatgaatatcattaagtcgttcgtcttcgtatgataaaagcaagttcatctgcttcgtcagtaggtgatttttttcgtccgtcaattgatatcctactacaatctcacgagcttttaaatttagtatttcactacggacggactcaaaatctgttaaaagggttgcctgaaactctccagttgagacatccatatatgctagaccaaatgtttgttgatcttgcgaatcaatcgctactaagaaattattagcactatccggcttcgttgactccacaaccgttcctggggtaacaacttgcactacctcacgcttgaccactcccacagcttttttaggatcttccatctgctcagcaatggctactttgtaacctaattcaactaaaacgtcaatatactgttgagctgagtgatagggaactcctgccattgggattggcttttctgcgttcttatttcgactagtcaagctaatttccaggatttgtgctgcttttaccgcatcatcataaaataattcataaaaatcacccattctaaaaagcaaaaaagcatctggataattctcttttatatccagatactgttgcattcccggtgatatcgttggcttggccatttctcactcctaactaacggggctggctgccatgctcagctcctcaatcattatatttataaacctactgatagttctttttcaaaaactttggcaatatcttcattttgacaaatcaccaacaaggtgtctgctcctgccattgttcctaaaatctctggcagccctttctcatcaataaagtttgctaaaacgctagcctcccctaaattagtatttaaaactaacataaaacttgctcgcgatactttcaaaatatatgagcgtaaggctgggctaaatcgatttgaagtagctgttgataaactataatatagcttaccttctgggctacgtaattttaaaagaccaatctcacgcaagtctcttgatagagtcgcttgcgtgacatcgattccttcattttttaaatgtaatttaatttcttcttgtgtgccaatctgccctgattggatcaaacgtttaatacgtttttggcgttctattttattcatgttattcaatcctttttagttagaattatgcttaccaaattatatcaaaaaaaattgtctttttcacttagtagtgatatcgtaatcattctgtaaaaaagctataaagtaggctagttctttacagaatgcattatgaatttaatcaacaagttctcgtctatttttcataattatgttaaaatagggtgactatattactaattaaaataggagataccatggatacaaaacatctaattgcgagtgaaattcaaaaagttgttccagatatggaacaatcgaccattctttctttattagaaaccccaaaaaattcgagcatgggagatttagctttcccagcattctctttggctaaaactctacgcaaagcacctcaaataattgctagtgacattgctgaacaaattaaaagcgaccaatttgaaaaggtggaagctgttggaccttacgttaactttttccttgataaagccgcaatctcaagtcaagttttaaaacaagtcttatctgatggttctgcctatgctactcaaaatattggtgaaggacgaaatgttgccattgacatgtctagtccaaatattgctaagccattctcaattggacaccttcgttcaacagttattggtgatagtttagctaatatttttgataaaattggctatcatcctgttaaaattaatcaccttggcgactggggtaaacaatttggaatgttaatcgttgcctataaaaaatggggcaatgaagaggctgtccgtgctcatcccatcgatgaacttttaaaactttatgtccgtattaatgctgaagccgagacagaccctagcgttgatgaagaggcacgtgagtggtttcgtaaacttgaagctaacgatcctgaagcaactgaattatggcaatggttccgtgacgagtcattattagaattcaaccgtctttacgatcaaatgaatgttacatttgatagctataacggcgaggcattctacaacgacaaaatggatgaagtgcttgaactgctagaatctaaaaacctcctagtcgaatctaaaggtgcacaagttgttaacctagaaaaatacggtattgaacatcctgccctcattaaaaaatccgatggagcaactctctacattacacgtgacttagctgctgcactttaccgtaaacgtacctacgattttgcaaaatcaatctacgttgtaggaaacgaacagtctgcacactttaagcaactaaaagctgtgcttaaagaaatggactacgattggtccgatgatatgactcatgttccttttggccttgtaacaaaaggaggagcaaaattatcaactcgtaaaggaaatgtaattctacttgaacctactgttgcagaagctattaatcgtgcggcatctcagattgaagctaaaaaccctaacctagcagataaagataaagttgctcaagcagttggtgtaggtgctattaaattttacgatttgaaaactgatcgtacaaatggttatgactttgacttagaagcaatggtatcatttgaaggtgaaactgggccatatgtacaatatgcacatgctcgtattcaatcaatcttacgtaaagctaactttagcccatctaatagcgataattacagtctcaacgatgttgaaagctgggaaatcatcaaactcatccaagattttcctcgtattattgtacgtgcggcagataattttgagccctctattattgcaaaattcgctattaatttagctcagtgcttcaataaatattacgcccacacacgtattttagatgaagacgctgaaatcagtagtcgtctagcactttgctatgcaactgctacagtattaaaagaatctcttcgcctcctaggagttgatgctccgaatgaaatgtaagaaatgacactactaagactgtcaaatttatgacagtcttaattttttatattataataatagcacaacaagttacaggagaatgccatgccatcagaaaaagaaatattagatgctcttagtaaagtttatagcgaagaagtaatacaagcagatgattattttcgtcaagctattttcgagctcgctagtcaacttgaaaaagaggggatgaactcactcctagctacaaaaattgactcacttatcaatcaatacgtcttaacacatcaatttgatgctcctaaaagcatatttgatcttagtcgcttggtaaaaacaaaagctagccattacaagggaactgctatctcagctattatgcttggtagtttcttaagtggaggaccaaaataaaaatacaggccagacagcctgtatttttatttatcgtaatttcttcgtcgaattttaaaatctgagctaataacttcatctacatttataacagaaataaaagcatctgggtctaaatcagccatgatttctttcacatcacgcacttcacttgggttaagagctacgtacaagacatcatgctctctacctgagtaggcaccttggccccgtaaaaaagttacacccctattaatttcatgcaaaatggttgctgctgcagattctgattctttggtaataatgatcattccacgaacagtgtagcccccattttcaacatttgttaacacttgactaaatacaaagctagctactaacgtatatagcatctgttgtaaattaatataaacaagtgaagacgttagaactatagcatcaataaacaataaggtttgccctaattttattccagatttttcctctacaatacgaccaataatatctgcaccacctgtagttgcaccatatctaaatactaaaccactaccagttcctgctaaaattccagcagctactgcaactaacatcatatcgtttttcaaagggactgttacagggatttgttgccaaaaccacatgaaaaaagacattaacactgtaccatatatagttaacaataaggattttttccctaaaatcctagcccctaatataaataacgggatattaaggagaagtgatgaaagtgctggattaactccgaaaagtgcatggataatcaaagtgacaccggaaatacctccttcagccaaatgattagccatattaaatttgacaaagccgaaagtatagagagccacaccaaaggcaattaaaatagtttcttttatctttgtttttaaatccagtttcaacataggcttaatccttccttattcaaaaaagctaaagttgtttaaacaacttagcttaataacatcataatgtttccttagtggtggctgaccaaaagtcatatatacagttaatcatcatcaacgaatcgtccaataatatgaacattttctgcaacggaaacaaaggcttttggatccgcttttagcattaaatatttaaaatcactaaattcttcacgtgttaatatagttattaaaactgcttttttctcatgattataagtaccttcagcatcattgatacaggttacaccacgatgtaaatcacgatggatacgtttaatgacgcaataaggcttactggtaacaatcatcgcttgcatctttttttgctttgtaaaaatggcatctgtaactctacttgatacaaaaatggtcaccatcgagtacaaagcgtacttccaaccaaataaaagacctgcaaataataaaataataccattaataataaaagaaatactacctacatctctgcctgttttctttctaattgtcaaactgataatatctgttcccccactagaaattctagacttaaagctaaaaccaacaccagctcccataattaaaccaccaaagatagcattgattaagggatcagttgtaagggtgatttgaggcattagttgaatgaagatagagcttacagttactgtgataaacgtaaaaatagtaaatttatgtccaatcttacgccaagataatatcagcaaagggatattaatggcataaaaagctaaagcaactggtatttcaaaagaaaaccagtgtttactgacagctgaaataacctgagctaaaccagttgctccacttgaataaacatgtccaggttgaaaaaagaaattgacagcaacactggatagaataccatacagcaatgaagccgaaattttctctgcatatttttctcgtgagatactttttaaagtgtgtaagagaccaaattttttagcccatacactgataatatattttacctttttttctaaaggggttcgtctagttttcataactttctacagtaagtgataattcttctaattgttgttctgaaacgagactaggagcttgagtcattggatcactagccttattgtttttagggaatgcaataacttctcgaatattgtccttgcctgctaacaacataacaaagcggtcaaggcctattgccaatccaccatgtggtgggaagccgtaatccatagcttcaagtaagaaaccaaactgttcctgagctgattcagcgctaaatcctaaagccttgaacatacgctcttgtgtatctttttggttaatacgtaggctaccaccgcctaactcatatccattcaaaacaatatcataggcaactgcacgtactttagccaaatccccttccaactcatgcgctgtctccgctgttggcaaggtgaatggatgatgagccgacatatatcgtccctcttcttctgaccactcaaacattggccaatcaacaacccataggaaattaaatttagaataatcaatgagttcaagttcttttgcaatgcgtgtacgaagcgctcctaaagtctcgttagctacttcaagactatctgctacaaatagaattaagtcattattctctagctgtaaagcttctgtcaacctaccttcaatagctgtcaagaacttagcaaccggacctgaaatagtattatctgcatattttagccatgctaaacctttggcaccgtattgttttgcaatttctgttaatttatcaatattttttcgagagtacttgtccgccttatctttgacaacaatcgctttaactactgaagcttctgagaacaccttgaagtcaacttctttgacaatttctgtcaagtcttgtaaaagcatatcaaaccttgtatcaggcttatcagacccgtagttattcattgcatcatcatatgccatccttgggaatggtaaagaaacctctaaacctttagtgtctttcattactttagcaatcataccctcaacaatgtcttgaatttcttgatcactaaggaatgatgtctctaagtcaacttgtgtaaactcaggttgacggtctccacgtaaatcctcatcacggaaacatttgacaatttgataataacgatcaaatcccgcattcatcaatagctgttttgtaatttgagggctttgtggaagggcataaaaatgtccttggttgacacgtgatggaaccaaatagtctcgtgccccctctggagttgattttgttagcatcggagtttcgacatcaataaactctaagttgtcaaggtaattacggattgagtgtgttactttcgcacgtaatttgaaattttcaagcatttccggacgacgaagatccaagtaacggtaacgcatgcgtgtatcatcatttgcctcaataccatctttaatttcaaatggtgttgttttcgaggtattaagaatcgataattcttgcacttttaattcaacttctcctgttggtaaattatcattagcttgttctcgtgctgtcactacaccgctaacctctataacaaattcactacggagactttctgcggttgccataactgaggctgatacttcttcaggattaataactaattgcatgattccctcgcgatcgcgaagatcaataaaaataaggcctccaaggtcacgacgacgaccaacccatccttttaaagtaatcgatgttcctatgtgctcactacgaacacgcccagcatacatactacgtttcatctgttttctccatttaaaatattcattccaacctattataacaaaaagcacctaaaaaccccacccattaaggagagtttttaggaactgttttacaatcctaattgtttaagcacagatgaaaaatctgttttaatgttttcaaaactaactttaacttcttgacgtgtttgattattttttaaaccgacctctttcgaatctacttcactgctacctaatgtcataatcactttagcattaaaagtatctgcagacttaaattgtgctttgattttacgacccaaataatcacgctctactttaaaaccctgatgacgtattgattgtgccaaatctaaggcagctagattagcctctgatcctaatacagctatatacagatctatagtattttctattggtaaagaaatcccttgcttatctaatattaagagcaagcgttctaatcctaatccaaaaccaaatgctggtgtttctggtccaccaaaataggatactaagccgtcataacggcctccagcacagatcgttaattcattatcttcaatctcagtgataaactcaaaaatagtatgattataataatcaagaccacgaaccatattagtatcaatgatgtatggaatatttagagcatcaagcatatgacacacagcatcaaagtgggcttggcttgactcatctaaataatctaaaatagaaggagcattttcaactgctagtttgtcttctggctccttagagtctagtacgcgcaatggattttcattcaaacgacgttgactatccttagacaattgttcacgtatgggtgttaagtaatcaataagagcttggcgataggcctgacgactttctggattccctaaactattaagatgaagtttaacgtttttgatacctaaatcttcaaatagatgatgtcccattgcgattgtttcaacatcagttgctggattatttgatccaaagcactcaacgcctacttgatgaaattctcgtaaacgaccagcctgtgggcgctcatatcggaacattgatccaatataatacattttggttggtttttgaacttctggtgcaaatagtttattttcaacataagaacgtacaacaggtgctgttccttctggacgaagcgtaatgtgacgatctcctttatcatgaaaatcatacatctcttttgtaacgatatccgttgtatccccaactgagcgactaataacctcgtaatgttcaaacattggtgtacgaatttcatcataatgatattgtttaaagagattgcgtataacattttcaacgtattgccactttgctgattctccaggtaagatatcctgagtcccttttggtttttgaagtttcataagtttacctcttcgattagttttctctttaaacattctaccattttttcttatattttaaacaagcatatatcatttgctttagtttgatagtattttcaccgtgaaattgtaaaaataaaaagttttgtcaagtaactttactttacaaaaaagatatgttatcatagtgaagttgatgaaaatcaaaacttacacatcgaaaggaagaataagaaaatggcaaaacctgcacgtcacacttcaaaagcgaagagaaacaaacgtcgtacacactacaaattgacagctccatctgtacaattcgacgaaactactggagattactcacgttcacaccgtgtatcactcaaaggatactacaaaggacgtaaaatcgctaaagctaacgaagctaaataatagaagggagataccatgcgcgtaaatattacacttgaacataaagaatctggtgaacgcttgtaccttacttcaaaaaacaaacgtaacactccagaccgtcttcaattgaaaaaatactcaccaaaacttcgtaaacacgttgttttcactgaagttaaataagacatcatacagaaagcctatgaaatcaacgtttctaggcttttttgcttgcttaaaatgtggttttgtctgatttttgtctgattaaaagtatattatctattcaaacatctcctatatccgtcatacttccaagtttttatggaatcactttaaagcaacttttttccacttgcgaatcttagttctaaatgttccgaaaggagctaccgtattaatatgaataaacttataaacttcccagactgcattcttagtcgcactatcagcccaatttctcatatgaggtttaaataggacttcgtcgctcattgaatcaatcatgttacctatagcatctacattatcattgagttgagccgtaagttctttgatggttagactagcgtaggtctcagtaaaatgctgatatagctctccaagttgattccatttaaacgtctcagttggtgttttaacttctaagccactctgttcatctgactcccattttagtatcagggtagtccagccaacctgataggctagattctccgctggtgtcctatcaacctcatcaattcttaaatctttcaacttctcaggaatgtcattgaattcagcaatatattttttatatgattttagtacttcttccttaagttcgtttttatctgaatatgttctcatttctttcctctttaatttagtcaagttcattgtatcatattcttttctctttttcttaggaagtacagcttttataattctatatatcaaatgaattttattcaatcaacttttctagcttttcaactgcccctctcatggtatctttttgcttcttaatcacatggagatagacacgctcaatctccttggaatcctccgagtgtccgacaaattctcgaatagtagggaggtcaataccttcgctagccataatagagataaagctatggcggaacatatgagggatgacatgaatcggtctgccaaagtctagaaagctatcgatatccttatagggcttgcctgctttcttgttatactttgctgactgactagagccacctctcaggaattgtgagagttcgttgtgataaagcggagagccttgtcgattacctgccctaatataggttctagtaaagagataccctaagtcttggtaagtcggactgaattgagcttgaaatttatttctgtcaatatagtgacgtagaatcttctcaacctcagggctcattggaatcgtgcggacactttccttggtcttaaggtctgctcggtagcgttccttttcgtcaagattgagtgcttccatcatatcatccgatttattcttacttgccctctgccaatgaacttttatccactttttctcaaaatcaagcatgtcttcatttaagcctaaaacctcacttggtcgcatgcctgttagaaaaatcattctcaatacatctgcgataagttggttatcaggtcgattagtccagctctctatcaggcggagaacatggttaacctcacttgcttctagatacttctctgctatatcttcacgcttcttgtcctgctcctcactctttgtcagaactcgccttttaaccttattgctggcaatcgggtcttgtgtaagagttatctgtccattttcaactgaccagtcaaaaatcatcttaaggtagatatgcagatttctcgccatgtgcatagaagaagcattgataagattttgaatttcatctgtcataaaggcaaatttcgtgatggacattctggtatcaaagttcggctcaatatagcgattatagatagtaacccttgttttaagggtattattggctggcttgaccctttcatgccatgctttaaaggctttaccgtaaaaatttccatctttatcaaatggcttggcgatttcttctagggttaaaagtttcttggctttcttaggcttaatgcccattagctcggcgatatagtcatcaactaatttattcagttcttgcgtgacctgagtaattaattgtgtgtttttaatatcgctgaccaagagacgttctttcccagaaggtaactttttgctcggtgttgccttggtggtaaaccaccctttactagcacctgtagaaaggtatttcttatgagattttttagtaatagggtgggtgaatcgcatagcgaatttcaccaagacattacccgccttataagggtctggtcgccaagaactgatgataagtactcttgaaccattatctctcatagggactacctacgccatctttgcgacatactgattggcaattttgtagtcaaaccacgccacaaagacttctgagtggataaagacattgccgtgtgttcctttgataccgaaagcgtaagggctgtctttcatctgacgaatgtaactattaagtgttgcaacggtcatgccatgccagagctcatctagaaagacggatttgcggtaccagttacgggttaagtcaaaatcatgttctgtttttaatgttgccattgaattctccttctgttttagttataatcaagttagttatttttggaaaggcgatttgtagcttgctacaggtcgtcttttcttatgccccaataggctgagcttagttgctcttgtttgtactgctgaatgtcagtctcgtctgtttcggttagcttagaaatccccaattcaagtaagtgctggatatagctatctgccttttcttgcccgtgagattccgccttagcgacatagagttttccgagtgttcgtgagacttgtttctctgtccacttctcagaacgttttagggtaggttttgtccgttttacgcttaagaccgtcttttcttgtgtctctagatagtcattccaccattttaccgtctttcttcgccaacggttagaatccttgtccctcgggctgacaaaacggtagtgtccgttaataacttcaaagtaaatctctttgagcggtcgcccctctttaatctgtttggctagtaaatttgctttttcctgccagcacctcagctctgctcttgtccatgataagggcgtatttggcaattcttggtctagcttttgttctaacaatttgttatagacacaccattgctgagtacctctaacaccaatcgtaaccatttcaccgaccttttcaccattttcaagaaggctcttttcatggtaatcaaaggttttagcggttgatatgcagagttgctttttacaataactgtaaatgagtgggacggatagactgtcatcaaagatatcgttggcaatatctagtctcgtaacgttactatgacattcagaaatgcgtttcatcaaggttacccagttattgacattgttttccatatattcttcatactgacggcacccctgccctctcagttcgataaagactcccatctttgattgccagtccttattgaagtaaacctttatctctgagaaggaataatgccgttgatacttgtttatcccccattcattgaggacaaacttgtctttaggaagaatgaggattttctcaatgacatcatctggagccaagcctttaatcgttacggctaaatagtctaacatcactgagttatccatgtctaggctccaataaatttaatatcggttgccactagctttaagccaccccaattccctccaccattattgttggctcgccaaccaagatggacttctggattgacaagttctaccacaagggagtttaacccatccttttcaacggatttagccaacttgtcaagattgtctacaatctccaagcgaatgcccttaaggtcatcagaagaatagcccaagtctttcaaggcttgaattttgtctgtatcttgtacagagcaagtgattttagccacttcatctgtcgcaatgctttcgccattgacatttttatagactggtgcaacccgtgaagaaaggatagtcactttctttggaatgtcaaattgtgatttatctaatttcaaatcaccaacttttatggtttcgtctgttaagttaaattttgtcatgtgtttttctcctgttcataaaagctacgcctacatgaaatctgtcataaatcgttgatatcatgggctttataaagatttttttcgtgaaatttgcttcaaatcgctgaaccccttgcttatcaagggttttgaccacatttcgtgtatgtgtgcaccccctaatagggaacggggtgcaatttcaatttcgatttcagccgtttgccaccttccccacctgctctgggctaccgtattgaccactcgcccagcggtggggtggcgaaccgtcttcatcgtttgaagaaaccaattctcttagatgttttatcccctgtctctttctctaagttctgaattctgacaagaagcacttctaacttctgtttcaactcagttaggtttctttggtaatcctcttgaatttccataaaagaaacttctagctcgtctacaagctctctaatgggtttctgatggtcttttcccttggaactcccataaacgcttagaattgccctctcaagccctaatgaggacttcttatccgcgaccgcttgaaagtaggcaaggtcatcatctgtaaagagatagattttagaataagatttccgacccgttctcactctactttctttaaattgagtaccagtcaagctttcaatttttaatcgccactttttcagtgttgaaactgagttaagaccgtcaaccctatccacaacttcttgataatcatattcattcattagcttacctgtgttttctgattgagaaagtcggtcacaatctgcaaggctctagattcaatcaatcgttcaaatcccgtactcttgataaggtgatagagttctctgtcatctaaatctttgcagtcctctggtttgatgaaaactttctcttgtgtctctggcgagtaggcaacccactccaccatttgtagttcaatacttgtttgattcataattaccctcttttctgacgtttgcatccaactagcatttatccgaaatatctggtataattacagtaattagatttactgtccttgaacgatgtaccagattgttcaaggattttttctaccttcctttcttttttgattgttaagttagctcctttctatcaataatatacgattttatatacgattgctgtaaattttttgaacaatcctaatgctcattaaaaattatatacgaaaacatatacgatgtcaagtattaaccacaaaaaaatgtacgattttataaactactatgttataatggtctgagaggtaacttatgtttgaaatacttaaacctgataaaaaggctgttgggaaaagattgaggcaagtcaaggatgagttaaatttgtcttttacagattttggaaatcgtcttggactaaaaaaatcaaccatcaacgcatatgtaagaggagataacttagcgcctcttgaagttttagaaaaagtatcaaaaatctatggaaaacctgtaggttggttttactatggagaattggaagaatatattgaactttaccttagaaaacttggttatggtacattcctagatgaatatcctgagacaccgttaaagataaaggatgagctttttaggattaaagcaaatccaaaacaattaatcacaactaacgggggagtaaccattggaacatttgagaatcctaattgggaaaatgactttggttacccaaatgaaggctacctagatgatatcttttttgaaatgctttgtgaaactctaaagaactcaattagacaggaagctcaaacctacctaagtcagcaagaaggacttgacgatactaaaatcaaagaactctctaattactttgccaaccaaatctacatctcatatgattttgtcggaaatttagaaaatctttctaaagataaaatcaagcaagaagttaaagaaagctatgaacgtctgcttaaagattcacctcaagcaggtgtagaagttagctatgattccaattacctacttggttttctaataaatacacttgcggatagtcaaacaacaaggcaattactttcagatatgtcacaagcaacagtcggtatgcctttttcacaatttcatgagggacacgaattagttgaggttatccaatctgtcagaccacggctgatagaactttacaataacacgacctttgatgattggactgactgggcggagaaatgattttagaaaggaagatgcaaatggataacaaattcaaaaatatcccaaaacggcatttaccacaaaaactcccatttgactacacgtcaatatatactgacccacaaatcattaaattaactactagggcaaatattgcaatcggtacttacgaaggatttctagagtctatcattaaccctatgctactaatctcccctttgcttagccaagaagccgttctctcttcaaaacttgaagggacccatgccaccttgaaagacttacttaattatgaagctggtaataaagtagatattgagcgtgatgaattgcatgaaatcattaactaccgaaaggctctcttttatgctctagaaaacatttccaccatcaacaacatcgattctaaaggattaccgttatccaatagaattattaaagaaatgcacaaaattcttctagataatgttagaggtagtagtaaaaatcctggtaattttaagagaagtcaaaactatatcggtagtgtatcctcgatttcatacactcctgtccccgcggaaaaaacaccagaatacatgtctaatttggagcaatatatccattatgatgacttagacttattggttcagtcagcaattatccatgctcaatttgaaatgattcacccttttgaagacggtaatggacgaattggacgattgcttataccactattcctgtactatcaggaactactttcttatccaacattttatatgagttcgtattttgaaagagataggtctctttacatatcacacctatcaaacatttcaaaagacaacaactggaaagactggtttgagtattacctagaaggagtgatattgtccgcagaagagagtacaaaaaaagctcaggacatactaagcctatataacattatgaaggaacaagtcatccctaaacttaattctgtttcaggtatccagcttcttgactttatattctcggctccaatctttaaggcagaacaagttagtgaacacctaaaaatttctaagagaactacctatactttactaaataagttaattgatgaaggttatctttcaacagataatgctcaaaggaatagaacctactattgtcctcaacttctttcaatcgttcaataaggtatctcttaatgaagtaatgttcacctctgcttcacttatttcttttttagtgaagcaaaagtcatctttacttctcttatctatttcttaatgaagcgaaacctgttttggcttcacttgttttttattatgtgaagcagagttggatttcgcttcacttagcgactggtaagtgacttatcatttatactttatttttatactgaataaaaggaattttacccatgcccaagaataggataaacaatttcatcaatataggaggcttaatcttagtaatctcttttctactattagtccttgatatagttaatcttccaacgaaatttggttttaatataaagactttaaatattgaaatttggaatatttacgctacgcttttaggaagcgggttaactctgtatggtgtaattataacaattaacagtcagtatgagtcacagatagaggatactaaacggattgtaaagcctatgattaatgtgtcacctgttgacgagtatagctacaaggataagtatattcaatttgactttatattccccaaagcatatccaaaccttttaagaaaggataatattgacactccaaatgtcaccatctctctggaaaatcttggaactagagaattgtataatttatatataggaaattttgaagctacttattttgatgatggtggctattattatcaacttaatccaattttatattcaaaccataaggtacaacttaatcttatgttctatgaaaaaaatggttatcttaaagaatttaatcaggaagataaatttcatttgctcatttctcctatcaaattttcaatctattttcaggattgcttgaataattggtacgaacaatcgtttaaattacgtattttccaccaagttcaagcagacaggtcagatgaagaaaattcactaacagttagtattgaaagagtagagatatattctgcccctaaagaaatttctcccgattcacttccgtggataactaatccaagtaagttatgccagtttgggtgaatcactaataaagcgaccacactcttatccaatttattagcagtgaactaaattttgtctgatttttgtctgattaaaactgatgcaagggcaaaatcactctatttcatcaataattgaaagatttaaaagcccgtaaaatcaacgtttctgaacgtaacaaatattgctaaatcacacattacgcttactgaagttaaataattgattataaaaaagcctatgaaatcaatatttctgggctttttatttttaaaaataaaatctgacaaaaaagtataaatttacctcttaccttcaggtagttagtcattcttttaaaactcacttttttataactgaaaatattgttcttaattttaaaaattcattttagattcattttacgactatatactcagaagtaacaaacctaatccaaggtttgaaaaaagaaagaaggaagtcagtatgacaaactataaaaacaactttaaaaaattcatgagcaataaattatacgtagggttagcttccattacgctacttggtattgggggagctataggagtaagtggagctgcattagcgcataaccatcactcagaacacatgtcttttgaacataagcatgaaggacacgataaacatcacgatcatagagaaaaatactcactaaaaacattaaagaatatctcgacaaaaatcgattataagactgccttagaaactgccaaaaaagaagctcgctcaggctttatttcacaaattgaattaaataccaaaggtgatacacctttttatgaaatcaaagttattgataataaaatagctaaaaaatataaaattgatgctaattctgggaagatcctttcaacaacatcagataatcaactcaattcaaaagatgcccaattaaaacaaccaagtaaagatattcagactgcattacaagctattcaagcaaaatataaaaatgcaaaaataaaagaaatttctcttgcgaataacaaatcaaataagctagtttataaagtaaaactacttgatggaaatactcctaagattgcccaatttgatagtgataaagcatcatttataaaggcaaataagcttaatacaactcataaaaatcacgactaatactagtgtattaaagggaataggacctcagtactccattcccttttgtgatataatggaaaaaagccatacggaggccaaaaaatgaaaatccttgttgttgaagatgagtttgacttgaaccgtagtattgtaaaacttttaaaaaagcaacactacagtgttgacagtgcttcaaatggtgaagaagccttacaatttgtttcagtggcagaatatgatgtgattatcttagatgtaatgatgccaaaaatggacggcttcacctttttaaaactgcttcgcaacaaaggaagtcaagtatctattcttatgttgactgctcgagatgccgttgaagatcgtatcgcaggtctagattttggtgcggatgattaccttgtaaaaccatttgaatttggagaactcatggcccgaattcgagctatgttacgacgtgcaaatagacaagtatcttctgatgatattcaaattcaagatataacaatcaatttatctacaaagcaagtttggagaaacgacaatttgattgatttaacagctaaggaatacgaagtccttgagtatttggcacgtcacagagaccaagtcctctctcgtcatcaaattcgtgaacacgtttgggattatgattattatggagagtccaatattattgatgtccttatcaaaaaccttcgtcgaaaactagataacaatcgagatggatcactaataaaaactaaacgaggtttaggatatgttattccaaagtaaaataaattaccctaaaaagtctagcatcatcactcaaattaccctctggtacagctcttttatttttatccttgttatcggtgtattaattggttcattttttatttcaaaaagcattgctgaaaacaaatctaaaaaaaatttagaagctaaagctgtgcaaatgagtcaagcgttagctaaaggtcatcggtatgaggcttttgaagatggaatattttattcagtctatgaccaaaatggaaaagttatctattctggttttccaaaaggatttaaaagggatttagaccatcaacataaacataaaaagaaattatctctattttccatggagaatcgtacctttcagtatgttgatattccaatttctgggaaaaatcagtggttacgtgctatccgtactgttgacagactggataagcaattaactgaattgttatttagtttgggtatcgttcttcctcttatgttgattataataactgttggtggctatttaattttaaagcgcacttttagaccgattcaagaaattactgaaaccgctcaatttattacccaaaatgaagactatactaagcgaattatcactaaaaataacgaaaatgaattaactgagctagcagctgttatcaatactatgttggcttctattgaatcatcatttgttcgggaaaaacaatttaacaatgatgtttctcatgaactacggactcctgtaacagttatactttctgaaagtgaatacggaaaaaactacgcagaaaatttaagtgaagcaaaagaatcctttgaggttatacaccgtcagtcactatcaatgaaaaaattagttgagcaacttctagaattgactaaggcagaaaatccattatcaattcagttagaacctcttaatttctcaattatgatgaagcaactagtatccgattcgagtagattattagataatacccctatacaccttgactctcaaatcgaagatgacctttggattataggtcaacaaacactactcaaacggctttttgataatctattttcaaatgctattaaatttacaaacaatcatatttctattagtctaagacagtccgataatcaaattgtcttctctattaaagataatggtctaggtatctcagttgatgaccaaagtaaaatttggaaccgtttctatcaagtggactctgctcgaaccaaggatagtcagtctggaattggtttagggctatctttagtaaaacaaatcgctacaatacaccgtgctaaaatatgggttgattctaaacctgatgatggcagtcagtttacgctcacctttccaaaattgaagaaagactagagaaaggaaataaaaaaaacgatagattacacctatcgttttttttatttaacttaaactcaatttattatatctcttcagatatttttgagactaatagctgaaatctttaaagtattaaaacttgtagaactaacaaaccgccaccaaatattaggaggaataaaacaaccggccacacaaattttagccaatgggagtacttcatatctaacatctgcaaggttgccataactagtccagtaggtgctaaaaacaacattgcatactgcccaaattgataagccattactactactgaacgaggaatcccaacagtatctgcaagaggtgctagaattggcattgaaagtactgctaaacccgacgaggatggaacaacaaatcctaacacaaagtagataaacatcataacaatgataaagacagagccactaacatgtgaagctaattttgaagctgtgtaaagcatcgtatctgatatataaccttggctcaaaataatattgataccacgcgctaaaccaatgattaatgaaaccccaacaaggcttgatgcaccattaacaaactcatcaacaacatccctttctccaataccatttgccccagttgctgttaaaaacataataataattgtaatagctaaaaaggaagaagccatggttggaaaccaccatccctgtgacattactccccaaaccatcaaaggaaatgaaataacaaataaacttaaaataattttttgtctaatagtaaagagtgagggtgtatggttagttgtcatgccccatttagcattaaattctactctatcttcataggaatatgaaaactctggattcgcttttatttttttagcataccaatgtagatacaccacaacaaaaatagcacctgcaatacaccctgctgtacgccatgataagccttctgtgaaactaataccagctgcatttgaagcaataacagaagaaaacggattaattgttgaaaatgatgtcccaacagaacttgctaagaaaatagcacctacacaaatgatagaatcataacccatggctaaaaagattggaactaaaataggataaaaagcaactgcttcttcttcaataccacatagagtaccgcctaaaaccatcaataaggaaactaaaaatatcaataaaaactctctacctttggttttctttgttaaagctagaagaccagactcaaaagcgccactctttctaactactcctatcatgcctccaagtaccatgataaataccataatatcaacagcttcaatggttccatttaccatactagtcgtcacggagccaatgcctgctggattttgcttcaaacgtttgtaagtatttggaactgaaactggcttactaatagcaccagaagtaaattctttaattttaattttgacattcatcttatccaactgtgtttgcgttgctggaacatgaactgtcttaccatttggatctgttactactagtttggatgatgctgtatcaaattgtaattttgaataggacccagcaggtatccaccatgtagccaaaaccgaaaagattgttaaaatgaataatattgtaaaggcacctggcattcgaaaacctttactccttttgttttcactgtttgtcattttttctggcatgacacgcctcctctataataaaaatagattgacttcatcagaaaaagtgcaaagatgaaggttaaataatcatttctttgcacttatctgagattacttagttatacgtgttcctaatttcccatctaatgcatcttctaaaccatttaatgaggtgattaaggctgttcctttcggattgtgatctaagaaactcatacaggctattactttaggtaacatacttccttttgcaaactcaccttggttaacgtaatcaatcatttgattctcattaacctctgttaaagctttttgattttctttaccaaattgagtataaacataatcaactgcagtgagaataatcaattgatccgcagctagttctcctgctaacagtgcactagatttgtctttatcaataacagctgcaataccttcataacctcccttattaatgacagggatgcctccacctccacctgcgataactagggtatcattttcaataagtgttttaatgctattaatttcgatgatttttttaggttcaggtgaagcaacaacacgacgataccctcgtccagcgtcttctacgaaagtataccctttctctatagcaatcttttctgatgtctccttatcataaaaggtgcctataggcttggtaggtgcgctaaatgcttggtctgattcatccacctcaatttgggtaataattgtagcaacttccttatttattccctcttgacgtaattcatttaaaaggctctgttggagatgatagcctatgtatccttggctcattgctccacattctggaaaaggaaaattagttccttgaccactctcagccgcaaaattcattcctaaattaatggcaccaacttgtggtccattaccatgacttacaacaatttcgtgtcccttttttatcaaggccaccaatgattttgcagtatgttttactaatcttaattgttcttctggagaatttcctaaggcatttcctcctagtgcaacaacaatttttgccatgaaaattcctcctaatcacctaaagttgctaccataactgctttaatagtatgcatacgattttcagcttcttggaaaacaactgagtgagggccttcaaaaacttcatctgatacttccatttccttcaaaccatatttttcataaatgtcgtatccaactttagtatctatattatgaaatgagggcaagcaatgctcgaaaataacgtttggattttctgtcatattaagcatttcttgggtaatacgatagggttctaaaagagctattctttctttccaaacttcatccggttctcccattgaaacccaaacatctgtatataggacgtctgaatctctgacgccttctgcaatatcagcagtgatttcaatagaagcaccagtagttttcgcaatttcttgacatttagagagtagttcaggatctggctctaattctttaggacaaaccaaatgataagtcatgcctacaatagaagcaccgatcatcaaggcattagcgacattgttacgtccatcacccacatacgtaaagcgaatatctttatagggcttatgtaagcattccttagcggtcagaaaatcggctagtacttgcgttggatgatcagcatcggttaaaccattccacacaggaactcctgaaaattcggctaaagtctcaactgtttcttgagaaaatccacgatactcaataccatcatacataccacctagcacacgcgcagtgtcttttgaggtctcttttttacccatctgactgcctgttggacctaaataagtaacatgagctccttgatcgtgagcagcaacttcaaaagcgcaacgtgtccgtgtagaatctttttcaaaaatcaaagcgatatttttaccaacaagtttttgttgttcaattcctgcgtatttagcacgttttaaatcttctgaaagttttaaaagaaattcaacttctgctgtactaaaatccaataaagtaagaaaactacggttacgtaaatttttcattgcttattgcctcctttttttttatactcttattgtagatatcgctttcaaaaataatcaaaattcatcaaaaatcttcaaaaaaactttaaggacatttatatgctagatatattatcagaaaaacatctagaaagaaggcagcgtattattatctctgcaatagctatcgccttagctgctcaaatcaatatctcaatacttgctgatgggtttattatgaccttatctttgttcattttgcctgtctttttatattttaatgacgacattaatccaattcttctctgtctaggaattacttttgcttctcctatcttcagaggaatcatattaagtatcgctggcgaggctgagattcatcaaataattgaattcgttttaactgatatggcgttttatatttgttatggcatcaccttttatactatttattggcatcgttcctaccgtaataaaggtacttttttcttttctatcattatttgtgattattttgccaaccttgtagaaattagttttctcataaagtttaacaattatactataactatattcgctactttatttgccatagcacttttgcgagcttttattagttgcgctgtggcttatacttatagttatctatcacttctcttacaaaaagacgatcacgaacgtcgatactattattttatgtggtcaacttcagccgttaaaagcgaggtttattttatgcaaaaaaatatcattgaaattgaaaacatcatgaaaaatgcttatttattagataaagagttatccaaatatcatctacctaaagaataccaacacctctctctagatatttcgcgggacgttcacgaagttaagaaagattaccaaaatattattaaaggcttaggaacctattttagtgtaaaaaatgaatcaactatggcattgaaagatatctttcaaattgttttatcttatactaggagtattattcaatttcggcatcaagatatcattattctcgaaaataataaatgtaatttgataatatcaaactattactatttactaaccattatttccaatatcgttttaaatgcagtagaagctattgataaacaaaaaaagggtacaatcagtgttcacacagaagaattagaagattttattaaaattgagattagtgataacggaccaggaatacctgataaaatgaaacacatgattttcaaacctggattttcgactaaatttgatgctaatggtgatatctatcgaggaatcgggctatcccacgtgcgtattttaatggaagagcaatatcaaggaacgataactgtttgtcctaatcagccaaatggaacaacatttacactgttattccgtaaaaatcgatttaagttaggagataatacgtgaaattctatattattgatgatgaccccactatcactatgattttacaagatattattgaagaagatttcaataatacagtagtcagagtgaataatgtctccagtaaagcatacaacgaattgctgattgcagatgttgatatcgtattgattgatttattaatgccaatattagacggtgtaacattagtccaaaaaatctataaacagcgttccgatttaaaatttattatgatttcccaagtcaaagataatgatttacgacaagaagcatataaagcaggaatcgaattttttattaataaacccattaatattattgaagtaaaaagcgtcgtgaaacgtgtcactgatactatcgaaatgcaaaaaaaattaaatacaatccaaaatctcctagaaaatacgccatcatatcaaaagcctataacgactagtaacctcactaaaatccgttcaatactcagttatttaggtattacttcagagacagcctacacagatattcttaacatctgtgaacttttattaaaacaagaattaaattttgcccaatttgattttcaaaaagaactttctatcgatgaacaccaacaaaaaatcattttacaacgtattcgtcgtgccgttaaaaaagctatgataaatatggctcatctgtacattgatgattttgaaaatgaattaacactgcaatatgctaatgcattgtttggatttcagaatatccataatgaggcacaacttattcaaggaaaaagcatgtatggtggtaaaatttcacttaaacattttttcgatgaacttattttacagagtaaaacgttttaagacttgtttaagcatggccttatatactataaccatcctaaaacttttcttttcataaatctccaacaaacaccttgtctaccgcaaggtgtttgtttttgcttctagtttatcgtttctgacaatttaaatgtcagatagttgtttgaatgtctactttatgctaatataaccctaatatcatacgacctacactcgttacgcactagaaagtaaattacatgatttcatttgaaaatgttagtaaatcatatggtgatcataccatcattgataatattagttgccatattcaaagaggagaattctttgtccttgtgggggccagtggcagtggtaaaactaccatcctcaagatgattaatcgtctcatcgaaccaagccaaggcgctattactttagatggggaaaacattacatcacttgatttgcgacaattacgcttagaaactggttatgtcttgcaacaaattgcacttttccctaatttaacagttggagaaaatatagaacttatccctgaaatgaagggctggtcaaaaggtgaccaaaaaaaagccgctagcgaccttcttgataaggtgggtttacctgctaaggactactttaatcgctatcctcatgagctctctggtggggaacaacaacgcataggtatcctacgagcaatcgttgctaaacctaaggtactacttatggatgagccattttctgctttagaccctatctcaagacgtcaattacaagatatcaccaaacaattacagtctgaattgggtattacattagtgtttgtcacccatgacatgaaggaagctatgcgtcttgcagatagaatttgtgttattaaggaaggtaagatagtgcaattggatagaccagaaataattcaaaataatccctctgaccaatttgttagaaccctatttgaagaggagaactgagtatgacaacactaatcactacctttcaagagcgttttggagattggactcaaagtcttattgaacacctccagctatcactactaacacttattttagcaactttaattgctattccactcggtatcatcattagtcattataaaaaaatcagtcatgttgtccttcagataactgggatatttcaaacaattccttctttagccttgcttggtttatttataccttttatgggaattggaactgtaccagctgtcgttgcactaattatttacgctctatttccaattttacaaaatactgtaacagtactgatgcaaattgatgctaatctcattgaggcagcaaccgcttttggaatgacacgttgggaaaggcttaaaaagtttgagttagctttaagtatgcctgttatcatctcaggcattagaactgcctctgttatgattattggtacagctacattagctagtcttatcggagctggtggccttggatcatttattttgttagggattgatcgcaacaatccttctctaattctcataggggcaatctcttctgctgtcttagctattatatttagtggtttaattggattactagaaaaggctagattacgaaccatagccgtttctggtatacttttactagcaggcttaggactatcctatgctccaaaatggatgcctggaacaaatactgcaacgataactgttgcagggaagttaggaactgaaccagatattttaattaatatgtacaaagaacttattgaggatcagacagatatcaaagttaagcttaaacctaatttcggaaaaacaactttcttatatcaagccctaaaatctggtgatattgatctttacccagagtttacaggtactattacatcaagtttacttaaaaatcctcctaaagtaagtaataaccctaaacaggtttacaacttagccaaaaacggtattttaaaacaagataagttgtcacttttgtcacctatggcttatcaaaacacctacgctgtagctgttaaaaaagattacgctgaagctaatcaactcaaaaatatcagcgacctaaaaaaattagataaactaaaagctggtttcactttagaatttaaggatagagaggatgggagtattggtttacagaaacattatggtttaaaccttgatatctcaaccttagaacctgctttacgataccaagctatcaatagtaaagatgtcaatattattgacgcttactctaccgatagtgaattaatccagtatcaacttcaaattctcaaagacgataagcatctatttccgccatatcaaggagcaccgctactaaggcaagatacgattaaaaaataccctcaagtaaaaaaagctctcaataaacttgctggtcatatcactgaaaaagaaatgcaagaaatgaactaccaagtagctgtaaagcataaatcagcagctacagtagctaaacaatatttaaaagcacatcatattataaagtagattcaagcaatcaatggtattaaatgatttaaaaagagcatgtcgcatgacatgctctttttaattgccaaataaagcttatttaacaatcttaattttactatcttccattaatagggcacaaatagcacaaattaaccaggacgaacgagaacaagaaatataacgttccgaccacaatggtgtaaacttcttcttatacttgtgtaaaccattaaatgagtagaaatgactaccgaaatgatagacaagatacgccattctctctttagcaaaacttgtttcaacgcgaccaactcctgataaaggtgccatccccaaatcaaaatagtggtatcccttctcttgataataagagaataatgataaaaagaggaaatccataacgccattcggaattttctgtttatcgtgacgcattaaatcaatagagataatactcttttcatagtttggcataatattagcaaaagcaacaacttcgtgttcagcattttttaccaaagctattggggcttgttggaaataatctttattaaaatatcctagtgagaaacctttttcaggacgtccttctaaccaagtattagaaatctcttccaaactatttagtagctcttgactatgtggcgattgtacaacttcgaaatagaaaccatccttttcaactctatttagggcatttctgaaaggtttgtacttattccctttaagagtaaacgtttctaaattaactaaagcatcctcaccaactttcataaagtcaaaaccatactcatgtaaaagtagtgtcaacttctgtccaatactgtaaaaaacaaggtcatagtctagcttatcagcatcatcaataaacgattcaatagcttcacgaatataagtgtcatcaccggctggttcccccataataagacatttattattgacaattacaaattggaacgcaacgcaatcttctccatttttttggtaccagtagagccttttatcatttaaaaaggctaaaccgctatccgaagaaccaccgtaagcttgaagtagttttttataacgatccacattgaacacatcaccaatctgacaagattttccttgtaaaatcttaaccaaacataaataaacgagagtaagaatcaacgtagccaatgctatcggctcccatgctatgatataatgcaggcgttcaatactaccacctgtaatatgagccctgatagggaatagtagtcctgcaatataaaatagaactcccattaaactaacgataatgattccatccttaatacgctcttcccagctataaataaattgttttttatagagagttggcttaatgactaataagcctaacaatagtaaaataaaccagaaagatagtcgccaactaatatgacctaaattaagataaaacaatgtcaaagtaatccagataatagcaattggaaaagcatttttcactttttgatcaatagttctagctaagagaataaaacaaacccccagcaataaacctggaaactgccataacatttgttcttgtaatgggtccaagcctagcttctgcaaccacataatataagtaatattttcaaaaaatgctgttgaaaatattaagaatgcacctaaaatacgcatcaaatggctcaccatggtttgtagaacagttgatactaactctttcgggacattttcataacgttgatttatttgactacctaaataatggataaagaaatagatacctgcaaagaatggaataatatagtaggctaaacgataaagtaataaccatgcaaccacagtttctttaggtagtccctcggcagcaaaccctgtaaatagaactaattcaaaacttcctaatccaccgggaataagggatacaatcccgacggcacaaccaatacaaaatagtggtaaaattttataaactggtagatgaatgcccattaaataaccgataattataaatgctgcggccgcacatccccattcaaaaaaagaaacaacacctaattttatacgagtactagatggcatatctccgaaataatggcttcctttatgaccagaaatccaataaataacaggaaaatacatactagcaccaattaataccaaataatagtaatcaacactagctttggcatgaaaaatatggctcatgattaaggcaatcacactaataaatgacagaccagaaataagatagggtaaaaaacgagtcacttctcttaggtcactcttctcttgaccttttttaccataaaaagccatgcgcaacccaatatcgattaagccaccgaatcctgacaagttattaaaagtgttgatacaccaactagtctgtaaaatataccttttgcttttatctgtacgtaaaagtccattcagtacaaagtcatatccggttgtcggtaagacagcgataacccccacaaggataattaagaaaagattcattggagataattgcccaaaaacactctttagttgctcaacagaaatagttcgtttcaaatgaatcatttcaacaataataagcactaaaacagatataaaaaatacaattttaatcacagaagtcagtgatttgactttttcaattagctttttcaacaatttctcctttcaacgtatcgttgataaacttttttgcaataatattaaaaacatgggaatcttgcttaataatgtgatgcccaaagccaactaaagaataaaactccccccttggaaaataagaagcaagtttcttagaatgatttaacttaattatgtccttatttccaaccaaaaccattacaggagttgacacatgctgtaaatcagctggactaatcttcaaatcctccaacataagcgaaataacttgagctttttgcctcatatacggaaagagtttccctaaatagtgaaggaatttataggcaatccttactaaaagaatatcccaccatcgctgaccatgaatagtcaggttccctgaattaagcaaaagccctctaaccatacctggaaacatcgtttgaaaaactaaagctaaattggcaccatcgctatggcctaccaatataactttatcaatctctaaatgaactaagatatcctttaagtcaactgctatttgcctgaaactaatggtatttagctttgcatgacttttgccatgccctctactatccataacaataacttggtaatacttagaaaaatatgctatttgcttatcaaaatagcgactacttaagctattgccatgtaaaaaaacaatcggttgaccttgaccaacgacacgataataaatatctgaaccatctttagtatgtaaccagttctcagtcataatcaaagtcacctctctttgaattcgtagttatattatactatttttaaagacaaattacttaaactacctgtattatgagaaaaaaatgattactaaaagccgttcaactaaatcgaacggctaagtagtattaaaataagaatgttaaaagagctaatataggtaaaccaccctgttttaataagatttttttatcaactgtcaaagcaccataaatagcaactagcaatacattgattaaaaaaacagctacaatttcttgattctgtgaaatatataacccataaaggaggaataggccaatcaagccgttgtatacaccttgattcttaaaaagtttaataacgggtaaatatgacaactcttctttagacatactaaaaatcttcccagtcatatttgactgggtggctaacgtctccaaatacataatataaaaatgttccaaagcagttaatgttgcaataattattgttaaagtagacatatcttctcctcctaaatactttgacataccatatcatactgttagtctatcactagatactttctattaatcttcttgtttacgataaataagaagagcaagtatcatcgatgatactaaaaagattactagcattctccattgatggttaacgtctcccgtcaacgagatggtctctcttaatcctgaaacagagtaagtcatcggtaaaaatggttgaattgtttgaaagaacttaggactcaattctattgggtaagttcctgcgcttgaaccaagctggaataataatattaataacgacaagaaggaaccatacctattatcccatcccactaaagcagttactaatgccatcaaagtccatgctgtcaataggataataaagtaggtttttccagggtaatctggtttaagacctatgaattgaactgcaaaaaataagatagttgctgctagagttgcaatgaatccattgattaataatttatttttagcccaactaaaacgattagctggctctttgccagataaagctttcgcaaaaataacattggctgataaagctaccaccatcaacgcaactgaaatcatgtatggtgccattccaacaccattcgtatcaacgctatcataatcttcatgcttgatagtgactgggctagatactgcattggcattatctttatttacagaaaccatggacaactggtccccagctttccccaaagaacttgataattgagaaacaccacctgacaactctgtcaacccatctgtcaactgatgtcctcccccagcaagcttattagaaccatctgcaattctatcagaaccactagctaattgccccgctccgtctctcaattgatccgatttactatctaaagtttgagctccctgacttgctttttgtgttcctgaaatcaattgattggatttactatctaaagttactgcacctttgcgtaattgccctacagcattcgtataatccgtgattccttttgtcaaggtttgactaccttgatataactgcttagtagccgttggcaatttttgaattttatctaaatctgagatagcttttaatactaaattgttagctgttcctgacaaagtttgaagattttgtgatccattattagaaggggctgaactagatgcttcactaagcacagttttcatattttctatatttgaagaaatatttgctgcaattgtctcagctgaagtaggtgttccagtaaccgctgaggtgatttgagattgttgttcaggggttaaacttttaaaagctgacgttgattgtaccgcagtcatttgcttttgtttatcagcagcagccgtattcatcaaagcctttgtacttgattcaatagttgataaaaaattaaataacttactattagtatcgctatcagtagttgctgtcgattgtaaatttgtaataatctgatttagattctttaatccatctgaaaggttctgcaaagtacgttcttgctctggttttagttgagttgcttgtgacaattgttgtaaaccatccgtcaacttttctgatccttccaccaatgcttgagacttatcatctaatttttgactaccttcactcaacttatgcacacctgttgtgtaagcagtaacaccatctgataatgtttctaacccgttagatagggtccccacaccatctgtataaaggtttattccactatttagtttattagctcctccagaaaaagtttgactagagcttgctaaaacatctaaattacttgtcaaggtttggctcccatcctgtagcttattagaaccatttaataattcttgactcccatcagcagctttattgatacctgttttcatagaacccatatttttaaaaactgattcagtataagtccctgtaatagattctgctacctcatcttttagtttattagctgctgtctcactcatttttgaagctacaaaactacgccccttagtagttttataagtaatatttaacctttctggtttttctgtcatgagagttgtcgcttttctagaaagatctttaggaaaggtaataaccatataatagtgacccttttctaattctttttctgctcttttagctgttgtaaaatggaaatctaagctatcatttttagacaaattgtcctccatatctttgccaattgaaatagtttttccatttaatttagccgatttatcttggttaacgactgccacaggtaaatttttagtattcccataaggatcccacattgagcttagaaagataacattatatagcgttggaatcagtgcaaccccagccatcgtaatccataattttgggctttttatgattgcttttaattcgtctaacattttttctcctattttggacatattgttcatttttttgataaaatatattatacagtgatgatagataatttcaagataaaaatctcgtttttggacactgtgtttaaaaatgtacaaaaatattaaggggtaattaatatggtaaacgatacgaggagagaaaaaacaaaaagagctattgaagcagctatgattacgttattaaaagatcagagcttcgatgaaatttcaacgattaatctaactaaaacagctggaatcagtcgttctagtttttatactcattataaagataaatatgaaatgattgatcaataccaacagtcactcttcaataaagtcgaatatatttttgatcgcaatcaatttaaaaaagaagatgccttgctcgaaatttttcaattcttagatagagaatcattatttgctgctctcttaacccaaaatggaacaaaagaaattcagacctacatccttaataaattacaattaatgctttctaaagaattacctgtggtcaatccagatgcaacaaagtctgatatcaaccgtttgtattatagtgtctatctcagtcatgctatttttggagtctatcaaatgtggataacacgaggaaaaaaagaaagccctcaacaaattacacaagtgctactcagtttattacctcaaacttaaaaccagccttccttataggctggtcatttttagttaggtttattttatcctcattataggatagcaacactaataaggactgacattataaatgacgatacatttgagaagacatatctaaaaattggcctacaagctcgttatgttctcctataaaatcaaagagctgatcctcactcagtacaccgcatttgagattattttctgtttgttctgatagtctaaaccagtcttcgctaccataaaattctcttaatttcacgtaatcttcatagtgcttttgaaaatcatctatagcttctactaatgcattgattctaggtttgaagctatcatacttctcttccatttcttctatttttaatctatcatttagattcataataaaatctccttagttatataagattcgacgagataagttatcattctcaagtatttgtaacgttaactctactatatcctttttacaaagtaaaaaattactcattacaaactgacagtgttgatttttattctaatgttagtttaaaatctttttggttcattaaatataatgactcactaaaaagtatatagcaaaaaaagcctataaaataggcttttaaagtatgtaatgtaataattaaagcattttgttgtagaattcaacgacaagtgcttcattgatttctgggttaatttcatcgcgttctggaaggcgagtcaatgaaccttcaagtttttcagcatcaaatgatacgaaagctggacgtcctaaagtagcttcaacagcttcaaggattgcaggtactttcattgatttttcacgaactgaaataacttgtcctggagtaacgcggtatgatgggatatcaacacgtttaccatcaacaaggatatgaccatggttaacaaattgacgagcttggcgacgagttgttgcaagtcctaaacgataaacaacgttatcaagacgacgctctaaaagaaccataaagttgaaaccaagagttccttcttttgctttagtagcttgtacgaacaagttacggaattgtttttcaccaagtccgtatgaaaaacgaagtttttgtttctcagctaactgcaagccatattctgaaagcttgctacggttattaggaccgtgctgaccaggtacgtagttacgacgtgccaattctttacctgtgcctgtaagtgataaaccaaggcgacgtgattgtttccatgatggaccagtataacgtgacatctaaatgtcctcctctaaaataattgaggaaataacgatttaaaaaatcctgattcgtgcaggggattttcgcctaaacagcaaagggtactagattagttaaccacctgttgacgagcttcatatttttctgctgttatttcacacaagctatattatatcatgaaaataatattgaatcaagtttttatgtctcttaaaccttaaatacaaatagacatctaataagtatttccaattataataagaaagattcttaattctaaccaccaatagagaattagtaaatttttttatagaaacaaaaaacctcagtcgaggttttcatactattctgctgactcgtcatcaaaataacgaattaaagttttctcagttaaaatatctgaataagtgtaagactctacataagtattatcaattgctcctggtacagctgcagtatccttatactctacgataaacaaagatgggtaaacttcaattaggcgcccaattttatttttttccctcttacgaccattttcgagagtaagttcgaccatctgtccctcatgtgacttgatatcttcttttatttttttcatttttgcaacatctgcaaatgcatcactcatattaacatctcctattcttcaaattgagctatactagaaaatttattatattccttttgaaacattaattttactgtcccacgcgcaccagcacggttcttttctaaaataacctcaacagtattatcttctacaatttcctctgcttcttcgccctctctacgataataatcatctcgatataagaaagcaacaatgtcagcatcttgttcaatcgatccagattcacgaatatcagataagaccggtcgtttatcctgcctttgctcaaccccacgagagagctggcttaatgcgataacaggaacctttaattctttagctaaaatcttcaactgccttgaaatttcagaaacttcttgctgacgattttctggtctagttcctgaaattaattggaggtagtcaatgacgattaaacctaaaccatcatcaacttcttgagataacttcctagagcgtgctctaatttctgtaattttaatcccgggcgtatcatcaatataaattggcgcatccgccaaagctccttgagcaatcgttacattattccaatcttgatccgtcaactgaccagttcgtaaactatgagaatcaaccattccctctgctgccaacatacggtcaactaaactctcagcccccatttcaagtgaaaaaatagctacaggtctattttgtttagttccaacattttgagcaatatttaaaacaaaggctgttttacctactgcaggacgggccgctaagatgattaattgatctggatgtaaacctgtagtaatcctgtctaaatctctaaatccagttggtaaacctgtgacatctgaggtttgctgtgaacgtaattctaagttttcgtaattaacttttaaaacatcagatatctttctaaacccgctacgattactgtgttcgttaatatcaactaaagccttctcagcggtggcaataatttcatcagaatcatttccttcataggccatgttgacagtatctgtcaacttagaaatgatatctcgcaacatggctttctcagaaactattttggcataaaactccgcattagcacttgttggaacactattaactaattcaacaatatagcccaacccaccaatgttttgaagatcaccttggtcatctaaaatatttctaacagtagcagcatcaattgcatcatttctatcagctaaggtaatcatcgctctgaagataactttgtgtgaatatttataaaaatcatctggacttataaattctctcaccataatcagtttctctggtgagataaagatagatcctagaacggcctgttctgccaacaggtcttgaggttgtactcttagctcagatacttctaccaaacttcattcctcctgacttgtcaacctttatcatctctcagtttacgcttctttgatatcaagcttaatctgtgaagaaacctgtttatgtaattttactggtacttcaaccttaccaatcgctctaatagtatgatctaaatcaatatgacgtttgtcaattttaatgccgtattgtttttgtaactcttcagcaatctttttggctgtgatagaaccaaacgtacgaccatctggacctaccttttcaataaattgcactcgggtagtttcggattctaattgtgttttcagctcctttgcctgtgctaaaatttctgcttgtgctttttcttcggacttttgttttccttttaattcaccgatagcttgtgtcgttgcttctttagctagattcttttttaataagaagttttgagcataaccagtaggtacttccttaacctcacctttttttcctttccccttaacatcttgtaaaaaaataactttcatctcaattaatcccttctattttcgactgtactattttctcttaaatcttcgtcaattatttccagtaacatacgtctaacttgctttacagacttgtcttgtatttgacaagcagcaaaactaaaatgtccgccaccaccaagtttttccataatacgctggacattgatattatttctactgcgcgctgaaataccaatatttgaactgtttttagtaataacaaaagtagcctcaatacctgccattgtcaacatggtgtcagctgctttactagctataacatgcgagtaaactttatgttcttctccggtagcaacaatgatgttatcataaatacgctcaccttttaaaatcaattcattaattaaacgatattcatcaaaatctgtagctgatattttttgaatagccatactattactacctaaaccgcgtaaatagcttgccacatcaaaagttctactcgttacattagatgcaaaatttcttgtatcaagcatgataccagccattaaaatacttgcttgactgcggcttaatttatctttagcttgttgaaattgaatcaattctgtaactaattcgctggcactacttgcgccactttctataaatgaaagaacagcattttttggaaaatcttcatctcttctatgatgatctaccacaataacatctgcaaacttgttaaagaattccttagataaggttaaagctgttttagaatggtctaccatgactaataaagaattttgagtaattaattcaaaagctctctcaacacttacgagacgtgtttcgccgtcttcttgcaagtaatcaattgctctttcaatatcagaattcatgtcatttgggtcataaactacataactggcattaacaatattactagcaaaaaattgcatccctacagatgcacctagtgcatccatgtccaatttcctgtgtcccacaataaagacactatcaactactttcaaacggtcagaaatagcagtcatcatagctctggtacgtgttcgtgaacgtttaatagttgaaacagcaccaccaccaaagtaaagtgcttttttactactatcattttcacgtactactatttgatctcctccgcgaacgagtgctgtattaagattttctaaagcaatttgcccaatttgattatggttaccatcaccataagaaattcccatacttaatgttaatgataaatggttttcctgagcgcgttttcgaaactcatttaaaatatcaaatttatcttttatcaatgtatttaaaacgctatagtcggtaaaaatatagtatcgatccatattgacacgacgataaaaaatatttttagactgtgtaaaatcagaaataaaactagtcacgaaggcgttaatctttgacatatcagcctctaacatagtatccataatatcatcgtagttatcaatggaaataataccaataactggacgtagcattgaactatcatagtttcttctattccccatgaaattatcgaagaaatagaaaacacccgtctctgtatccaaataagctgaatatttgttatcaccgtattcaaatgattgcccagccgttccattacgtctactagtaatgatatctttaacagtagcagactgaaaatgaccattatccccagtaaaaatcaattctgcataagggttaaaccactcaatatcatttgtttcaagatcaaattgtataacaccaactggcatttgttcaagaagactcttaagagaaacttctgtttgatcattaagtaattcaatttgttcaacttcagatagttcataagttatcttttggtaatataataaggcaacaacaaaagataaagcaacaaaaatagccaataatagagccgtataggattgaaataacctaacacaaatagctaatagtccaaataaaatcaggcctattaaaactaaatggacggttgcaaaacgaaatcttttcattaaataacctcttaagacctaattataacacaaaacgcccctgataaacaggggcgaacactattatcaattgatatttttacgacctttttgtcttccttcaaggtaaaccattaaaatactaatatcggctggattaactcctgaaatacgactagcctgacctagcgtttctgggttaatttttttgaatttttgtctagcttctgttgcgatagaatcaatgtcgtcccagtcaatatgagggggaatacgtttttcttccattcgtttcatttttgcaacttgatctaaagcctttttaatatagccttcgtatttaatttcagtttccaaaagttcaataaccttactgtctaatggctcatcagcacaaccaacaaaatccgttgctactgcatatgtgatttgtgggcggcgcataaattctttggcagttaaagcatctgtcaaaggtttaaagcccaattcttgaatccgtttatttgtctcagaaactggctttaactttatagagtctaaacgttctaattcattttcaaattgcatttgacgctttttaaatatcgcataacgctcttcatctactaggccaatctcataaccgatttctgttaaacgcatatctgcattatcatgacgaagaatcagacgatattctgcgcgacttgtcaacagacgatatggttctagagtccctttggtaactaaatcatcaatcatgacaccaatgtaagcatcacttcgttttaaaataagttctggcttcccttgaactttaagagcagcgttgatcccagcaaccaacccttgaccagcagcttcttcataacctgaagtaccattagtctgtcctgcagtaaacaaaccagcaattacttttgtttcgagtgttgctcttaattgatgaggcaatacaatatcatactcaatagcatagcctgtacgcatcatttcagcattttcaagcccttttatagaacgtaataaatcaacttgaacatcctcaggaagactcgttgatagcccttgaacataaacttcttcagtgtatctaccttctggttctaagaagagttggtggcgctctttatcagcaaaacgcacaattttatcttcaattgacggacaatatctaggaccaactcccttaacgattccagaaaacataggagcacggtgtagattttgattgatgatgtcatgactcaaagtattcgtataggtcaaccagcacggtacctggtcagtaatataatcttcatccctagacataaatgaaaaatgatttggttgctcatccccaggttgtatctctgtcttttcataattaatagaggaggcttttacacgaggaggtgttccagttttgaaacgaccaatttctaatcctaggtctcttaaattatctgccaatgtcacagaagctaaactattattagggcccgaggagtacttaagatcacctaatataatctctcctcgaagagcagtacctgttgttataacaacagattttgctgaaaatttctgattagttgctgtacgaacccccacaacctttccatcttcaacaagtatttcgtcaatcatagcttgtcttaaggtaagattttcttgcttttctacagtttgcttcattgtttgtgcatagagggctttatcagcttgtgctcttaaggcacggacagcaggccccttacctgtattaagcattttcatttgtatataggttttatcaatgtttttacccatttcaccacctaaagcgtcaatctctctgacaacgatacctttagcagagccacctatagaaggattacaaggcataaatgctaacatttctaagttgatagtggctagaagtgtcttacatcccatacgactagcagctagactagcttccacacctgcatgacccgctccaacaacgataatatcatagttttctgcaaattatgtgtcattttattcctttccaatttcaaagtctaattcattaaaacacaaaaatagccaaaactctcgaaaattgtacgtcaaaaagacttacaaattccatgagctttgaccatcatagttattgttaaatttattttagcatttatcttttaaaagtcaaccagaggggataggctatgttaaatgaaaaccaatttttatgcctgttattagcatctctatcccgatagtcatcaaaataagtcccatcattttggtgattatagtcattgcattttttccaagaaatttagtaatttcgtttgcacttattaaaataacatacattatcacacataatatggcaaaagcaagtatagtaatgagtttgccagataaaccaccacttgataaccccatagcagttgcaatagtacccggacctgccaaaaggggcattgctaatggtgaaactgccacattcattggatcatccttatgctcctctaggtttttattggttggtgaatgtataccattaatcattttataacctataatgcctaccaatattccaccagatatttttagggcggctagggtaatcccaaataagttaaaaagtaagtggccacttaatacaaagattacaataatgacaaaagcaagtaatactccttttgctgcaatccgacgtgaaatcttctgatcatcatcagctactaaagccataaaagctggcaaattagaaatgggattcataatggcgaaaaaagccatgaaagctaaaataaattttgaaatcatacgattacctcacttaataattaagtgtcaattaaatgtattgacagattttatcatcacgataagcctgatcaatcatcccaccgcctaaacattcttgttcattataaaaaacaacagcttgacctggtgtgattgctcgttgtaaatcatcaaacacaacccttgcttgattaccttttacgtaaactgtaactttactgtcaggttgacgatatctgaacttagctgtacattctagcttaaattcattaggcatatcacgtgtaaagtggatttcagaagctgtcaagctagttgacatcaatgagtcatgatagaaaccttgacctacataaagaatgtttttacttaaatcctttccaactacaaaccaaggtttattatctccaccatgttgcccaccaataccaaggccccctctttgaccaatagtataatacattaaaccagcatgttcacccatgtcacgaccatcaacagtcatcatacgacctggttgagccggtaaatattgacccaggaaatccttgaaatttttttctccaataaaacaaataccagtagagtcttttttcttagcggtcgcaagtcctgcttcttcagctatacggcgaacttctggtttttgtaaatgaccaagtggaaataacgttttttgcaattgctcctgagataattgacttagaaaataagtttgatccttattattatctgctcctctaagcatatgaactattccgttctcatcacgtgttacttgtgcataatgacctgttgctacatagtcagcacctaatgtcatcgcataatctagaaatgctttaaatttaatttccttattacacataacatctggatttggcgtacgacctgctcgatattctgctaaaaaatattcgaaaaccctgtcccaatactctttttcaaagttgacagagtagtatggtatgccgatctgatcagcaacagcagcaacatctttataatcttcagtagccgtacaaacaccaaattcatctgtgtcatcccaatttttcataaaaacaccaataacatcataaccttgctcttttaaaagcagggcagttactgatgaatcaacacctccactcatgcctacaacgacacgaatgtttgaattatcagtcataagaattctcccatcaaaaagttttatttttaacttaggcttgaagggccaagttgttcttagatcaatcatattgactaagaaacactataaaagtgcttatatattatagcactatttgttgtcaagttgtatgtttttgttgtgataaatatttattacattgcagtttttttatctttttatgatattttttagaaataatctgttataatgagaatgtacaaaaatcacgaggaaaaactatgaaacatttaaaatttcaatcggtcttcgacattattggtcctgttatgattggaccatcaagtagtcatactgcaggagctgtccgcattggtaaagttgtccattctatttttggtgaacctagtgaagtaacctttcatttatacaattcttttgctaaaacttaccaaggacacggtactgataaagcattggttgcagggattctaggaatggatacagataatccagatattaaaaactctcttgaaattgctcatcaaaaaggaattaagatttactgggatatcctaaaagatagtaattcaccacatccaaatactgcgaaaataactgttaaaaatggggataggagcatgagtattacaggagtgtcaattggtggcggaaacatccaagttactgagttgaatggattctcagtttcattaacaatgaatactcctactttaattatcgttcatcaagatatacctggcatgattgctaaagtaactgatattttatctgactttaacattaatattgctcaaatgaatgtaacacgcgaaagtgcaggagaaaaagctatcatgattatagaagtagattcacgagattgtcaacaagctgtcaaaaagatagaagctattcctcatttacacaatgtcaacttctttgattaagagaaagggtaactatgttttatacaattgaagagctggtagagcaagctaatagccaacataagggtaacatagcagagctcatgatccaaacggaaattgaaatgactggtagaagtcgtgaagaaattcgttatattatgtcccgaaatcttgaagtcatgaaagcttctgttattgatggattaacccctagtaaatcaatcagtggtttaacaggcggtgatgctgtcaagatggatcaatatttacaatcaggaaaaactatttcagataccacaatcctagctgccgttaggaatgctatggctgttaatgagttaaatgctaagatgggactggtctgtgcaacaccaactgcaggtagtgcaggatgtttaccagctgtgatttctacagccattgaaaagcttaatttaacagaagaagagcaacttgattttctatttacagccggcgcatttggtctcgtcattggtaataatgcctctatctcaggtgcagaaggaggttgccaagctgaagttgggtcagctagtgctatggctgcggctgctttagttatggctgctggaggtactcctttccaagctagccaagctatagcatttgttattaaaaatatgcttggacttatctgtgaccctgttgcaggtttagttgaagtcccttgtgtgaagcggaatgctcttggatcaagttttgcacttgttgctgctgatatggccttggctggtattgaatcgcaaattccagtagatgaagttattgatgcaatgtatcaagttggatcaagtttaccgactgcttttcgtgagactgcagaaggaggacttgctgccacgccgacaggaagacgttatagtaaagaaatttttggggaataaagtttatcaattttctactctttccctgaaaataaataaaaacgctacagctttactgtagcgtttttatttatttgttttagcaatctgtaattattgttgacaacagtgtaaagttaatttatagctattcactagtaaccccaagctgataaaccttgagcacgataagctttaatagctgaattaacttgatcctgaactgtagctgttgaaccccaacctggcatcgtttggaaaagtcctgaagctcctgaggcattagcaacattaggattaccatttgattcacgggcaataatatgttcccaagtagactgagggactcctgttgcagcagccatttgtgctgcagctgctgagccaatagcccctgcagtatttccattactcaatacttggccactcgtctggtgttgagcaggtctataagttgtctcagtaacagcataagcttgttgtgcctgactggtagcaggggtgttttctgttacaactgcttgttctacagctgcctcttcactcgcagtaacttgttgctgagaattagcttctgtagattgagaacttgattttggggcttcattagatgcctgagaaggttttggagcctgttttacatcttctacttttgatttagatgtcgccttagtcatttttgattttttggctacgcgaactttatctgcttttgacaaagattcagtagtaacttgtgaacttttaaagatgaccattacagccaaaatacatgaaaaaagggctactaaagtgatagctccataagctaaatgatgtttttttacattcaattttgataattttcttcttttattcatgttacctatattatactttatttgttaccttgcaattgaatagatgttaaaaatattacaaagagatttaattttaagtaaatctctttgttttatcaacttttattaataccagccgttactattccaaaatgatagcgctgccgaccaagatccgtaacgagaaaccacataattgtccgctactttttcttgattttcaggagataagtcgccatttaggtaagattgagacagttgatatcttccataatattgtccattctgtgcagtataactaccatttgattcacgacgagctatttcttcttttgcggctgaatcacttgaactcaaatttgatgaagaattcattgaattttcaattgttggttgagattttgcttctgcttgactagctgtagaattatccaattttaaaacatcacctatactgatgacatcagcgttactgatactattgagagacactaactcttgtaccgtagttttatgatttttagcaatagctgataaggtatcacctgatttcacggtataagatgctgcgcttactgaaagtggtaaagctaatgaagcacccactaaaagacctgccactcctaatttaaatggttttgattttttaaccgaggttattgacataatatatgctctctttcattaattgatacgcgtactatcataccttgtaaatattactaattgttttgccttagatgaaatttattacaaataaattgtaaattaataaagaaaaggcctccaaaaaacaatttttagttttctttaagtaaagttgttgagcttttcacattatataaatgaaaaggctaagaccataaactgatcttaaccttttaattttttaatagaaacaaactcaaacccaataataacataagtaatatactaaaagtatcccgaacagtccacttcaataaacggtacttactacgattggctccgccttgataacctcttgcttccatagcaattgccaacgcatctgctcttttaaaactagaagcaaataatggaatcaaaatagggataatagacttaaccttatgaattaggtttccctctccaaaatcaactccacgagctctttgagcattcatgatacgtgttgtatcatccattaaagtaggaacgaaacgtaagctaagggataacatcaaaccaatctcgtgtgctggtactctcagtacttccaatggttttaacaaagattcaacagcatctgctaaacttaacggagtagtagttaaggtaagtaatgtcgaaaagaagataattaaaacaaatctcataaaaataagtgctgcttgttgtaacccaaggctagtgatgctaaaaatccaaaacgagaagataacctgcccgccttgtgcaaacagcatctggaagagggttgtaaataaaataataccaaccatcggtttaataccattgaaaaaataggaaaattttatctgagataaacccacaataaccaacgtaaaaatgaatacgatcacatttgtcactacattatttgcccaaaaaacaataatgataaaaagcaacatggctagtaacttacttcgaggatctaatttatgaatgagagaattacctggtatgtaacgtcccaaaatcaatttatccatgcttaatagcctccacaaattcgttaatagtaattggtaaactaggtaaatttaatcccttatgagatagtctttgagcaaacttggtgattttgggaactcctaattgtttactttctaaaagttctacttcttgaaaaatctgttttggttgtcctgataaggttactttccctgcttctaaaacatacacatagtcagcataatccgctacatcgtccattaagtgagtcactaagacgatagtcattccttttttatgaagatttttaaaaagagtcattaattcttttcttcccttaggatcaagtccagctgttggctcatccagtactagtactttgggttccatcgctaaaataccagctatagcaacccgcctcatctgccctccagaaagttcaaatggatttttatcgaataaatcctcactgataccaactaaccttaatttttcttcagccagcctttcagcttcaatctgagaaataccaaaattttgtggtccaaaagcaacatcctttaaaactgtctcttcaaaaagctgactttctggaaattgaaaaactaaaccaactttttgccttataaatttgatttctttgttcttgtcccctgctttaatagaaaaatcatcgacaattacctcaccttttgtaggaatatgtaaaccattcaaaagttgcataatagttgattttccagaacctgtgtgcccaatgaacgcggtataggaagcatcttcaattttcagattgacgtcaaaaagggcacgcccttcaaaaggagtgccggcttgataggtataacttacatttttaaattcaattcccataattgttcttctaattccttctctgtaagatactctgtccctatatcaagaccattagcagccagttctgccattaacctacttgtaaagggaacatctaaacctaaactaatcaaacgatttccacgaccaaataacgcttttggagtggatgtcgactcaactttaccatttttcataacgatgacacgatcactcaatgcaacttcatctaagtcgtgtgtaattgaaataacagtaagattatatttttgacgaatagctcgtatcgttcttatcagttccaatcgtccctcaggatcaagcatactagtcgcctcatccaagatgataacttgtggacgcatagctacagctcctgcaatggctacacgctgcttttgtcctccagataaacgtgcaggctccctcattttaaattcagacattcctaccaaatcaagtgcttggtccactctttctttcatgtctttcaaaggaatacctttattttccaaaccaaaggcgacgtcatcttcaacagttgcccctacaaattggttatcaggattttgaaataccatgccaatcttgtgacgtaactcccagacattatcttcggttaactcttgtccatcaatgataatctggccagactccgcctctaaaagtccatctattaaacgaacagtagtggatttcccagaaccattatgaccaataatagatagccattctccttgtttcacatgaaacgatacattctccaattgataatgtgtttgattactatcatatttaaaaaagagattattaacggtaataatatttgtcattatttaaaagtatccttaaataagaagcctgcacctttaaaatagtcgtagcctgaatacaaggtaaagaatagagcaatgtataacatgatgttaccaagtgtcatccaatgtactaacaaaaaaataactgcaaacatttgagtagccgtctttattttccctggcatagctgcagcaagtactgttccacctgtttcaactaaaagtaaacgcaaacctgtaactgctaactctctacaaatgataatagctgaaacccaagctggtgctaagtctagtccaactaacatgataaaagcactcataactagcattttatcagctaatgggtctgcaaatttcccaaaatttgttactacttgccatttacgtgctagataaccatctaggtaatcggtcaaacttgcaatagcaaatacaatagctgcaacaatatgccaagttgtacttgttgttactgaagttaatactataaataacggaatcattaaaattctgactacagttaatagattcggaatattttctttcttcatcataaattctccttttggaaacatagtattcctatattatgttatttcaaaactagtaaaagacttttgacataccaactttatagatgtctaagcttccttattatatcaaaatttcagattatttacgaagattttggaaaaataacgaagtcagatgtgtcagcattatctaagaaatccttaccaatcgtaatgacatcttccaaatctaattcttcaacgatagatggcaaatccaaatacatcgtttttccatcatataaataggtgacgaattgcattgcgagattttcaatagaatctaagcttcttaaaaaatcgccatagagctctctcttaacgttttttaagtggctttcggtaagatcagatgattgcaaagcattttttagcaataacctcaactgagttgaaaaagcaattggctctgtcgtatctaaagaaataataacgcactcaaaatctggatgaacttcaatttctatatcaaaagaatcatcaatttgaccagattcgtaccagtcttggttaattgtagaagtccatcctaaaagcattgcaaaaaatagctgtaatccgattttctcttttaggtaagaaccatgtatcatatgatttgattttcgataaccaatagctaatttaggttttgtcactgtcatatggcaagagttgttttttataacaggctcaaggctaatagaatctcggtcaatattctgtgagtaacttgtgaaatgagaatttttttgaaggtaagttataatttcttgtggactaaattgtccaacaagaactaaattcatattagacaactgataaaagtctttgtgattttcttgtaaatcggttaaggttatttgagagattgattggtaatctccagcgatatcaaatgctaatggagagttggggtaaaggttcgataacactccttgataaagcctatattctgggtcatcttgatacatttcaatttcttgtttgataatatctttttctttagtaattgactcttctgtaaagtttgttgtcaatacaaagtcaagtagtatatctaagcagtttgtaatgtgacttatagttgaaaaataaaaactagttttatcaaaagttgtaaaggcgttactctcggcgccatatttagtaaattgagttgcagcgtcttgtcctttatccagttcaaataatttatgttctaagaagtgagcaattcctgccggataatgttctacacaaccattcctcgtatattttgtatggagtgatccaaaatttgctgtcaatactccaacagtttccttaaatgatggctttggaataaggtatacatttagtccgctctctaatgttaacttatatacttcctcctgaaggttctgataagttattttattaactgtcatcctagtttccttccaaaaaataaaaagcttgtaattttaattttgttgctacgctgacaatatctgattttgttacatcgtctactttgtcaatgaatagtgctgaagtatgaaactgatctaaataatgttcatgataaatgtggtcaactatgaccttaggattatcagaagctaaaacatagttcattttcaatatatcttttgtttgtttcaataatgtagaagaaaacctgcccatcttaatattattgaattgcttattaataagcttcaaaaaacgctcacgattctctttatcaatacctgcatatatcgtaaagagacctgtaaagctgtcaaattgactacctatagtataggctaaaccttgcttttctcgaatttctgtaaacaacaaggagtgggcaaaagcaccaaataaaccgttaaatactattaaagcaaaataatcttcatctttataagttattggaagatgataagccaattgcataatagattgattaacgtccttatcttctacttgacttctcgttatattttcataagtctgcgtataatcaaaagctaatactttgtgacgtggctcaaatgccatacgattaaaagcctgaatcattcgatagtcatcaaaatcccctacgacaaaaatatctaattgatcttccttaagcatcttctgaaattcttgataagctgtaaatgaattttctgattccactaaagatgctgtaccatacttaggtaaacgaagtgtcttattattgtagaataaagattttagtgctaagtcactgctataaaaattatcttcaatatcagcctctaaatattgaataaggtttttcttctcagtatcaaaaatagatgtttgatactgttctaaagaaattaaaggagaaaacagcatatcctccaagaatgtaataatttgttcaacgatattttcttgttctaaagtaaaggtatttttaacaaatacaatatcaatatcaacaatgtgaacaagacccttagtagaaatcttagttgataaactagcgccatataaggaagctaacttttctcgaaattcttgtaccttaggatacttagcatttgcagtaactaacatttgagcaacgagcgatctacgtgctactgttttattattaaaatcacctgaaaatcgaaaagtaagatgattagtcttaaattgttggtttttaattaaatgtagagaaacgccttcaactattttcattcaatatcctttgtgttctgtattgttagctaagattatatcatttttaaaggcgttaaaaaagattaaacatccaagatatgattaattctaaatttcaatcttcttcaaaattgacaaagtcgtcaaccaatatttactcccattttttataccttgtctccatatcataagttcaactcaaaaaataattttatgctataatgatgtgatatctaaaattggagattaaaaagtcatggattataaattatttgatgaatatattactttacaatcacttctaaaagagattggtatcattcaaagtggcggagccattaaaaaatttttagcggataatcgagtattgtttaacggtgaccttgaaaataggcgtggaaagaaactccgcctgggggatattattactattcctgatcaaaatatcgagatcattataaggaagccatcagatcaagaaattgaagaacgtaatatagaaatagctgaaaaacagcgtgtttcagcaatcgttaaagaaatgaataaaaacaccaacaaaggtaaatcaaaaactagcaaaaaaccagttcgctttccagggacataaaaatgtggataaaaaatatttctttaaaacattatcgtaattatgaagaagcacaagtagatttttcacccaacctcaatattttcattggccgcaatgctcaaggaaagacaaattttttagaagcaatctacttcttggctttgactcgaagtcaccgtacccgttctgataaagaacttgtacattttaaacaccatgatgtacaaattacaggtgaggtaatccgcaaaagtggccatcttaacttagatattcaattatctgaaaaaggaagaatcactaaagttaaccatcttaaacaggcaaaattatctgattatattggggctatgactgtcgtactttttgcccctgaagatcttcaattagttaaaggtgcacctagtctaagacgaaaatttttagatatagatattggacaaattaagccaacgtacttagctgaactttcaaattacaatcatgtattaaaacaaagaaacacttatctaaaaactactaataacgtcgacaaaacttttttaacagtccttgatgaacaattagctgattatggaagtcgtgtcattgaacaccgttttgattttatccaagccctaaatgatgaagcggacaaacatcactacattatcagtactgagttagaacatttatctattcactacaaatcgtcaatagagtttacagataagtcaagtattagggaacattttttaaaccaattatctaaaagccactcaagagacatctttaagaaaaacacaagcatcggacctcatcgtgatgatattactttctttattaatgatatcaatgctacttttgctagccaagggcaacaaagaagccttattttatcattgaaattagcagaaattgagctaataaaaaccgttaccaacgattatccgattctcttacttgacgacgtcatgagtgaacttgacaaccatcgtcaactaaaactcttagagggaatcaaagagaatgttcaaacatttattactacaacaagtttagaacatttaagtgctttacctgatcaactcaaaatctttaacgttagtgatggtactattagtattaatgaaaaaaaagcaacagattaatctgttgctttttaataagatttaacaataccaagtaatatagcacccataacaaaacaaaggatacccatgacaacccacttctgctctttcttcgtttttgtctcacctaaaaataaaataccaccaataatagagataattactccaagttgagaaaaactaaaagcaattgctagccctgctttagctgctgccaataacatgaagacattaccaacgccccacatgagacctgtaatcatatttttaacaacaacagcctcaaagttaacacgaaacttcatgaaacaaattgcacctagacacattccaacagccatgggtaaaataacggccatagcgtcgaacttcataatgttattaaataaaactgcgtatgagatgtaacctacagttgaataagcaattgtagcaaatccttttgaaaactcttgatgtgttgccaaagcttgttctgagacatcacgtttacttgagaaatagaagccgataactaataatgtcaacgctgtcaatcctaaaataaattggattggcttagtccattcatgaaagactaaagcaccaactaggcttccacctactaattgtgcaccacttgacagtggattagcaacagagactcccatatatttcattgcttggaattgaccattttggccgactgaccataggataccacctaagataccaaaaatccacaatgaggcagtcatctctggctgtttaaataaccatacgataatcgcaaatagcaatgctcctaaagtcattccaaatgtttgttgatttggacgtcctccaattttattactaacaaatccaatacttccccacgcaaacatgggaatcaatgcaataagtaaaccttccaattctttctccttacaatggaatattaagtattacctattttcaatcctagagaatctattgactaactttattagcaagatcagcaaatactatagctttatcaacactatctttttccaaagctataatgacttgttttatcaataaattgaccagtgatttagaataaggtaactgttctttagtcatattactaatcttatttaaaataacatcttcaggtaaaatatcttgaaaatagcagatgactttgaaataaaaatcattgtactgtgtcacaccattcagataagtaactaccaggttaatctcatcttgaggcagcctcatatttaaccctaaatttgaaataaaaagtttagccaatattttgagaacattgctttctattctatcacaggattgttgtttttggaaactgaaaattctcatgatatcttcattatctcgataagattccagtaaagttaattgctctaaatcagtattagaagttccagccttaacttttgaatctagaatggatacttcattgatagttaccccaacctccaacgtttgtaaagctttaataaatttatcaatacctatttgtgtctcaccattttcaaaacgtgatagagttgattttgataattgagcacttttggctagagaacttagggatatacctttgtcctctctcaactcttttaaaatttttccataatttttcatacaaaaactttactatatttgtttcttttatgcaacaaaaagcatcctcataggggatgctttttgcccttattttagtgtactgaataatttggtgcctcatttgtaatttgaacatcatggggatggctttctttcaagccagctcctgacatttcaacaaattgagcattatcatgaagttcttttatgttcgctgcacctacatatcccataccagagcgaatgccaccaagcatttggaaaacaatatcggctactgaacctttgtatgctacacgaccttcaataccttctggaaccaatttgttagcctcgtttacagaaccttggaaataacgatcgcttgaaccttttttcattgctgcaattgagcccataccacggtatgtcttgaacttacgcccttggaaaatttctgtttctcctggcgcttcatctgttcctgcaaacattgaacctagcataactgcatttccacctgctgcaagtgcttttacaatatcacctgaatatttaataccaccatcagcaatgatagtcttaccgtactcacgcgcaacagccgctgcatcgtaaatagctgtaatctgaggaacacctaccccagcaacgacacgagtcgtacaaattgaacctggaccaataccaactttaacgacatccacacctgcatcataaagtgcacgcgctccttctgctgtagcaatatttcccgcaatcaatgtgcgattagggaagtgagcacgaatttcagcaattttacggagcacaccagctgaatgtccatgtgctgtatcaatgacaatagcatctgcacctgcttcaaacaaagcttctgcacgttcaaaagtatcagaggttacacctactgcacctgcaactaagagacgtccaaattcatcttttgctgccttaggaaattcaataactttttcgatatccttaatagtaataagtcctgaaagacgtccctcatcatctactaaaggtagcttttcaatacgatgctcatgaagaatacgctctgcagtttcaagatctgtaccaataggagctgttacaagattttgacttgtcatgtgctctgagattagttgtttataatcagaaatgaaacgcatatcacggttagtaataattccaactaatttacgattctcgagtgtctctacaataggaactccactaatgcgatagttttgcatcaattcctcagcttcagagacagtattatctggtgtcaagaagaatgggtcaataataacaccattttctgagcgtttaactttacgaacttcttctgcttgatcaactattgacatatttttatgaatgataccaagcccaccagcacgtgcaatagcaatagccatcttactatctgtaactgtatccattgcagctgtaatgattggaatgtttaatgtcaaattatcagccaactttgtcttcatatcaacttcatttggtaaaacatggctttcagcaggaataagcagaacatcatcaaaagtaaaaccttttttcaaaaacttagtatcccaatttgacatcaaaaaatcctcttttcttagatagtagatataaaaaatcccattaaaattatattgttactatcatatcacgctaaaatcatttgtcaatataaaaagagcatagaattaatagcttctagctctttaaagtaatgaaaaaatcttcttaattttctatttttttgagaagaagaaaggcggcgtatactgacttaatttctcaaaacacttttgagcttcttcactattattacaaataatcaaacaagtatcatcaccacagacagttgctaagatctcaggtaataaaatcgaatctaatatggagccaaaagattgagctaagccaggtagtgtcttcaaaacgatttggttttgaactggaaacagcatgactagggcatcttccatgtaaaaacgtaaccgttcttcccaacgcttctgagatatactatgaatctcataataagtttctgtagcattatcactgctttcgttaaccttaattaaattaagttccttcatatctcgagataatgttgcttgcgtcactgaaacgccatttttttctagtaattcccttaactcatgttgtgtacgcaccttagtctcagagactaaggaacgaattaattggtgtcttgtttcttttttattcatataaactccttattcaatgaatttcttgaaataatttttattattatagagaagcttctttcctttcatttcaacgatatctttttggcgtaattcctttaaaacatgactaactgtctcgcgagtagttccgctcatattggcaatttcaatcgttgtaataggaaaaggtaaatgtcccctttctgtaggaacttgcaaaagtagagttgcaagcgattggataactctcatactggcacttgaagtcaccatattacgaagtcgtatttcatgaactcgtaatagcttagaatatttccgacaaagatgcttcatttgattgatattttgaagagagtattcttcgtataaagccattggcagagaaaaatactcaatatccgtaatagccactgctgaaaaatggtaatcatcatccaaaaagagacctccataaggaaaaaccgtaccttgtctaacataatctgtataaatgaaagaaccagaagcgtctgattgttcaatttttacatgtcctgactggattaaaaacagtttttcacggtaatcaccttcaaaaaataaggtatgattttttagagctgtacgatgtttaatgtggctcacaatatggtcaaattgttcaatagtaaagtgtttaaaatcatctagttgtctgaaataaaaatattgttcttttgtaatcacctgattttctagacctttctaatcattagatgcgaacattttttgtataatgaaaattttttaatgtataaaattttcttgtcacgataaatcctccttcattatagcaaaaaaattcgtagaaagaacgtttttcgttgaattttgaaaacgcttttgagaaaatgtaattgttctgatatcttttaaaaaaattgagaggccttcatgactaaatttattgttgattcatcgtactggaatttgtttccaacttctaaaattggagtaatcttaatcaaagattatcacatggacagaaaccttgaaacagaacttaaacagttactgtctgatagtcattctttagcaaaaaaatatttgcaagagaaagaattcagtcaaaacagagttatccaaacttatcgcaaagcatatcaaacctttaaaactaaaaaaggtgcacgttcaagtatcgaagcattattgaagcgagttaattcaggaaacgaaattactagtataaatcctctagttgatatctataatgccgctagccttaggtttggattacctattggtgctgaggatagtgatacatttagaggtgatttaaaactaactattaccaatggtggtgatgaattttacttgattggcgaagattttaacagaccaactctttcaggtgagcttgcctatgttgatgatgttggagcagtttgccgctgttttaattggcgtgatggaaaacgtactatgattaccgataatactcagaatgcttttttagttatcgaattaattgataatggaagagaaattatttttaaagaagcgttggactttatcgccaccaatacaaatcgttttctaaaagctaaaacacagaccatcatattagataaagaacacagtgaaataacgctataacattaaaacgaaaagtaaaaattttacttttcgttatttttttaggttaataatttctcactttccaacgataaaagaaagaaattgtatagaaatcgctttcatttctataaatttaaatttttttggatataatcgtgacattcttaacacttttaatgcgaataacttccctattttatattcaaaagaaagtagaatgtaaatgtagatatagagataaatcctgtttcaatacaaatctctaactaagaaaggagtaaaatatgactcaaacacatccaattcatgttttctcagaaattggaaaacttaaaaaagttatgctacaccgtccaggtaaagaaatagaaaatctgatgcctgattatttagagagactcttgtttgatgatatcccatttttggaagatgcacaaaaagaacacgatgcgtttgcacaagcacttcgcaacgaaggagtcgaagtactttaccttgaaaatcttgctgccgagtcgttaacaaaccaagaaattcgtgaacagtttatcgatgagtacattggcgaagcaaatgttcgcggtcgtgctactaaaaaagctattcgagaattattactcaatatcaaagataataaagaacttatcgaaaaaactatggcaggtatccaaaagtctgagctacctgaaatcccatcttctgaaaaaggtctaactgatcttgtcgaatctaattatccatttgccatagatccgatgccaaatctttactttacacgtgatccatttgcaactattgggaatggagtttcattaaatcatatgttctctgaaacacgtaatcgcgaaactttatacggtaaatatatctttacacatcacccagagtacggtggaaaagtccctatggtctatgaacgtgaagaaacaactcgtattgaaggtggagatgagcttgtcctttctaaagatgtccttgccgttggtatctctcaacgtactgatgctgcctctattgaaaaactcttagtcaatatttttaaacaaaatttaggttttaaaaaggttttagcatttgaatttgcaaataatcgtaaatttatgcaccttgacacagtctttacaatggttgactatgacaagtttacaattcacccagaaattgaaggcgatcttcgcgtttactctgtaacttacgaaaaccaagatcttcatattgaagaagaaaaaggtgatttggcagatcttctagcgaaaaacctaggagttgagaaagtggaattgattcgttgtgggggtgacaacttagtcgctgctggacgtgaacaatggaatgatggttcaaatacattaactatagcaccaggtgtcgttatcgtttacaacagaaatacaatcacaaatgcaatcttagagtccaaaggattgaaattaattaagattaatggaagtgaattagttcgtgggcgtggtggaccacgctgcatgtcaatgccatttgaacgtgaagacctttaaaatttatgaagctattagtcaatcacttgccttaccaaagagctgcaagcctatatattcgcttttctgttttcgttatcgaaagaaatataaaaatggaagaagaattcgatgataatgacgagcaagatactatttatgctgttctttatgatgggaaacagccagtttcaacaggacgctttcttcctgaaactcaaacagaagctcgtttgactcgaattgcgactttaaaaggttatcgtggtaacggctatggtaccaaaattattatagcactagaaaattatgcaaaagaaaatggttatcactatctaactatacatgctgaattgacagcaaaagatttctaccagacacttgggtatcaagctactgggaatatttatatggaagacggggaagcctgtcaaacactcgaaaaatatttaatttaaaggagacattaacatatgacacaagtatttcaaggacgtagtttcttagcagaaaaagatttttctcgtgaggaatttgaatatcttattgatttttcagctcatttaaaagaccttaaaaaacgtggtgttcctcatcattatcttgaaggtaaaaatattgctctcttatttgaaaaaacatctactcgtactcgcgcagcctttacaactgcagcaattgacctaggcgctcatccggaataccttggtgcaaatgatattcaacttggtaaaaaagaatcaacagaagatactgctaaggttttaggacgtatgtttgatggtattgaattccgtggttttagccaaagaatggttgaagagcttgctgaattttctggagtacctgtctggaatggtttaacagatgaatggcatccaacacaaatgctagctgactaccttactatcaaagaaaacttcggtaaacttgaaggtattactcttgtttactgtggtgacggacgtaacaatgttgccaactcgcttttagtggctgggactttgatgggggtcaatgtacacatcttttctccaaaagaacttttccctgctgaagagattgttaaattggctgaagaatatgccaaagagtccggggctcacgttctcgttactgataatgtagacgaagctgtaaagggagcagatgtcttttacactgatgtctgggtatcgatgggagaagaagataagttcaaagaacgcgttgaacttcttcaaccatatcaagtaaacatggaactgattaaaaaagctaataatgataatcttatcttcttacactgcttacctgcattccatgatacaaataccgtttacggcaaagacgtcgctgaaaaatttggcgtcaaggaaatggaagttactgatgaagtcttccgtagcaaatatgctcgtcatttcgaccaagctgaaaatcgtatgcacactattaaagctgtaatggctgcaacccttggaaatcttttcattccaaaagtttaaattaaacgactatagggagttgacatatagtcaattccctattttaggaaatgaggtataaaatggaaaaagaaaaaaaattaggtcttttaccactaacaatgcttgtcattggctctcttatcggtggcggaatctttgatttaatgcaaaatatgagttccagagccggtttggtaccaatgcttattgcttgggtaattactgctatcgggatggggactttcgttttaagttttcaaaatttatctgaaaaaaggccggacctaacagctggaatctttagttacgctaaagaggggtttggaaactttatgggatttaactctgcatggggttattggttatcagcttggcttggaaatgttgcctacgctgcactcttattcagttcactcggttatttctttaaattctttggtaatggaaataatatcatctcaattattggagcaagtatagttatttgggttgtccatttcttaattttaagaggtgttaatacagctgcatttattaataccatagttacctttgcaaaattagtacctgttattattttcttaatttcagcgttattagctttcaaatttaacatttttagtcttgatatctggggaaatggattacatcaatcaattttcaaccaagtcaattcaactatgaaaaccgctgtttgggtatttattggtattgagggcgccgttgtcttctcaggtcgtgctaaaaaacactctgatattggtaaagcaagtatcctagcattattcactatgatttcactttatgtattgatttctgttttatcacttggtatcatgtcacgtccagaacttgcaaacttaaaaacaccagctatggcttacgttctagaaaaggctgttggtcactggggcgctatcttagttaaccttggtgttatcatttcagtatttggcgctattcttgcttggactttatttgcagcagaattaccatatcaagctgctaaagaaggtgcttttcctaaattctttgcaaaagaaaataaaaacaaagctccaatcaattcactcttagtcactaatctttgtgtacaagcattcttaatcacgttcttattcacacaaagtgcttatcgttttggtttcgcattagcatcatctgctatcttaattccttatgcttttacagcactatatcaattacaattcacactccgtgaggataagtcaactccaggacatcaaaagaatttaattatcggtatcctcgctacaatctatgctgtttaccttatctacgctggtggttttgattacttacttttgacaatgattgcttacactctaggtatgattctctatattaaaatgagaaaagatgacaagcttcctatctttgtgggatatgaaaaaattagtgccattgtcattctagcgctttgcttattatgtattattgaaattatgactggacaaattgacattgctgcaatcctagcaggttagtcattagaaagagggataaattggtaaaagaacatcaaaaaatcgtagttgccttaggtggcaacgctattctatcaacagatgcttcagcaaaagcacaacaagaagcattaatcaacacatcaaaatcactggtcaaactgattaaagaaggccatgatgtcattgttactcatggaaatggtccccaagttggtaacttattgctacagcaagcagcttcagattctgaaaagaatccagcaatgcctttggatacttgtgttgccatgacagaaggaagtattggtttttggttacaaaatgctcttaacaatgaattacaagaacaaggcattgacaaagaggttgcaacagtggtaactcaagttattgtagatgaaaaagatcaagctttcactaatccaacaaaacctattggcccattcttatctgaagaagatgccaagaaacaagcccaagaaacaggttcaaaatttaaagaagatgctggccgtggatggcgtaaagtcgttccttcaccaaaaccggttggtatcaaagaagcttctgttattagacggttagtggactctggtgtggttgttattagcgcaggtggcggaggtgtaccagttattgaagatgctaatacaaaggcattaaaaggggttgaagctgttattgacaaagactttgccagtcaaactttatcagaacttgttgatgctgacttattcatcgtcttaactggcgttgacaacgtttttgttaattttaataaacctaatcaagaaaaattagaagaagttactgtttcacaaatgaaacaatatatcactgaaaatcaatttgcccctggaagtatgctaccaaaggtcgaagctgcgattgcttttgttgaaaataaacctgaatcacgagctattattacttcacttgaaaatattgataatgttttagcccaaaatgcagggacacaaattgttgcaaattaaacaatgtagattaccattacatacactccttattaatgtcactccttaggcattcctataataaaagagagctagatatatctagctctcttttattataggacatatattatttaaaatagttcaaacccatggctgatttaacctcatccaaagtagaggctgcaacagcttgagctttctcactacctttttgtaacatttgataaacttgtcccatatctttagcatattcgaggcgacgttctctaataggtgataattcacgctctaagatatcaagtagataacgttttgttttaacatccccaagtccacctttttgatagtgttctttcatagcagtaatctctttttggtcttcatctcttccaaaaacatcaaggtaatgaaataccatattaccttcgatttgtcctggttcttctactttaatgtggtttggatcagtatacatactcataacttttttcttaactgtatccatatcatctgctaaaaagattccattatttaatgacttagacatttttgcattaccatctaaccctggcagacgacctgctgcatcattttctggatagattccctctggttcaactaaaacctgacaattataagcatgattgaaagatctaactatttcacgtgtttgttcaatcattggtttttggtcagtccctacaggaacaaggttagctttaaaagcggttatatcagctgcttgtgcaacaggataaactaagaatcctgctggaatagactcaccaaaacctttttgagcaatttctgtttttacagttggattacgttctaaacgtgcaagtgaaaccaagttcatataatacatacttaattctgctaactcaggaatttgactttgaatgaataaagtcgacttgtttggatctaacccaacagctaaataatcaagtgcaacattaccaattgattcaacaatagtttgcggatctttagcatggtctgtcagtgcttgttggtctgctaaaaagacaaataaagtatagctaccctcattttgaagtagaactctattttttaagctacctacataatgtccaatatgcaactttcctgtcggtctatcacctgttaagataattggttttgtcatgtttactccttaatataccaaagatatcatttcatatagttatcttatcatgtcacaagccctattgcaattcatccctacaagaaacattcaccttattaagatgattaaacattatgtaacgttaaatcgttcttaataatttcaatcgtataatgaatcataataattaaaagcgttatcgtcacacctaaaatagctctatatgcaaaaatatcgtaaactattgcagctaccaatgctccaataataaatgctagaactaccagtgaataattgatagctcgtcttttttgcatagccgttctctgacgattaacaatatactcataccaaaattgtagcattttccgataattaccagaagtcattaagatagtatatggttccgattcaatgcgacttcctgaaaatgtcaacattaaaatacctgtgctaaaggctaataaagctacccagatattgtggtttacattttcaacaaaaggaataaacatcgtagaaagtaaaaggggacataatgcatatagacgccaaaaagctgttactgcacgttctttaatcacaataccaaccaaaaaaccaattgaaaaaaagaaaatagaaaataatttagtgataaaaaagtgaaaatcattttgtccgagatttgccaccatcaagataatattacctgtctgtgttgcaacaagggagtgaaactgcatgtgactataaacgtcaataaaaccaccaataaaacccaataatacagccatttttcttccatcttgtggcattataatatcatctctgcgcattatagcaaattctccttcttgtattatcatgttttctattatataccaataaaataggcattcaactcaaaaatatcgagaaatttcttttctaaatttacttgactaccaagtctcgctgttagataataggtaataataagttttgataaaataaaaatgttatgactgagttgtcaatattatttattgacagctttctctttttatcatgttattattactaaagttaaggagcttatcatgtctaaaaaaattaagaattttatactattaaatattggatctctaattgttgcatttggtttcaacgctttctttcttcataatcatattgtcacgggggggattagtggtttggcagttagttttcatgaagtatttggttgggattctgctttttttattatgattatcaatattccattgctccttctttgctactttggcttaggtaaacaaacctttttaaaaactgtctatggttcttggatttttcctgtttttattaagttaacacaaagtgtaccaactttgacccacaacccactcctcgcagcactttttggaggtgttattgtaggatgtggtttggggattgttttttggagcgactcttcaactggtggaacggggattatcattcaattcttaggaaaatatactcctataagccttggacaaggggttatattgattgatggacttgttacaattgttggtttcctagcttttgacagtgatacggttatgttttctattattgggttgataactattagttatattattaatgctatccaaactggatttacaaccttaagcactgtcttaatcgtttctcaagagcaccaaaaaattaagacatatatcaatactgtcgcagatagaggagtaacagaaattcccgttaaagggggatattctggaactaatcaaatcatgcttatgacaactattgctggttatgagtttgctaaattacaagaggcaatagcagaaattgacgaaacagccttcataacagtaactccaacatcacaagcttctggacgtggatttagtcttcaaaaaaatcatggacgtcttgatgaagacattcttatgccaatgtaatcgattgataattaaagctttttctagtagaatagcagatagaatatacacaagaggtaacaaaattgcttacagtttcagatgtttcactacgttttagtgatcgcaaattatttgatgaagttaacattaactttacagcaggaaatacctatggtcttatcggagcaaatggcgctggtaaatcaactttccttaaaattttagctggtgatattgaaccaacaacaggacatattgcacttggcccagatgaacgcctttctgtacttcgccaaaatcattttgattatgaagatgagcgcgtcattgatgtcgttatcatgggtaatgaaacactttatagtatcatgaaagaaaaggatgctatctacatgaaagaagatttttctgatgaagatggtgttcgcgctgcggaattagaaggagaatttgctgaactcggtggatgggaggctgaaagtgaggcttctcaattactccaaaatctaaatatttcagaagagcttcattatcaaaatatgagtgaactagctaatggagacaaagttaaagttctccttgcaaaagctctctttggtaaaccagatgtacttctccttgacgagcctaccaatggacttgatatccagtctattacttggttagaagatttcttgattgactttgaaaatacagttattgtagtttcccacgaccgtcatttcttgaataaagtatgtacacatatggctgaccttgattttggaaaaattaaactgttcgtcggtaactatgatttctggaaagaatcatcagaattagcagctcgtttacaagctgatcgtaatgctaaagcagaagaaaaaattaaacaacttcaagaattcgttgcacgattttcagcgaatgcttcaaaatcaaaacaagcaacttctcgtaaaaaaatgcttgataaaattgaacttgaagagattgtaccatcaagccgtaaatacccattcgttaactttaaagccgaacgcgaaatgggaaatgatttattgaccgttgaaaatctctctgtcactattgatggggaaaaaatccttgataatatcagtttcattcttcgtcctggtgataaaactgcacttattggacaaaatgatatccaaactactgcacttattcgagcattgatgggggatatcgaatatgaaggaacaatcaaatggggagtaacaactagtcgttcttaccttccaaaagacaattcacgagattttgcttctggcgagtcaatcttagaatggcttcgtcaatttgctagtaaagaagaagacgataataccttcttacgtggtttcctaggtcgtatgcttttctctggagatgaggttaacaaatctgttaatgtcttatctgggggtgaaaaagtacgcgttatgctttcgaaattaatgctattaaaatctaatgttcttgttcttgatgatccaacaaaccacttagatttggaatctatttcaagtctcaacgatggactaaaagatttcaaagaatctattatttttgcaagtcatgaccacgagtttattcaaactttagcgaaccatattattgttctttctaaaaacggagttatcgatcgtatcgatgaaacttacgatgaatttcttgaaaataccgaagtacaagctaaggtcgctcaactctggaaataatcctttggcatatctctaacctaataaacgtgtcaagattgaaaatcttaaaactatattaatcatttaaataaaaaggttggaacaaatagtgtccagcctttttatcttaggagatatatatgacaattaaccactataagcttcgtataccttactatacaataagctttctacttcccttcataatcatagtctgtatcctctttactaagaatatttattggggaagtccaacaaccatattagcaagcgatggctttcatcaatatgttatctttaatcaagcattaagaaatattcttcatggttcaaacagcttattctatacctttacaagcggtttaggtttaaatttttatgctctgagtagttactatttgggaagttttttatccccaatagtttatttctttaacctaaaaaatatgcctgatgctatctaccttttaacaatatgtaaaatagggttgataggtttgtcaatgtttgtcactctttgtaaacgtcattgtaaagttaatcgtgtcttacttttagtaatttctacttgctatagcttaatgagtttctcaattagccaaattgaaattaatatgtggctagatgtatttattctaattccccttgttgttttaggagttgatcagctactatgggaaagaaaacctatactttatttcctctctctgacagccttattcatccaaaactattattttggttttatgactgccatctttactagcctttacttcatcgtacaaataacccgtaatactgatagtaaggttgcatttaaacaatttcttcattttacctttttatctcttttagctggtatgactagtagcattatgattttgccaacttattttgatttaactactcatggtgaaaagttgacaaaggtatcgaagatgtttacagaaaattcttggtacatggatttgtttgctaaaaatatgattggagcctatgatacaacaaaatttggctctattcctatgatttatgtaggtttacttcctttactcctttctttactttactttacaataaaggaagttcctcgaaggactagattagcatatggatttttaataatatttgttattgctagtttttatataacacctctagatttattttggcaagggatgcatgctccaaatatgtttctccatcgctactcttgggtactttcagtacttatctgtctgctagctgctgaatgccttgagtatttagacaacatttcttggaaaaagattttaggggtcaatttaattttagtaagtggtttcataatcacgtttttatttaaaaagcattatcattaccttaatcttgaattacttcttttaaccttaactttcctctcagcttatattattctaactattagttttgtcagtaagcaaatccctaaattagttttttatccctttcttattggttttgttgtattagagatgacattaaacaccttttaccaactaaatagtcttaacgatgaatggatatttccatctaggcaaggatatgctaaatataatcacagcattagcaaacttgtcagaaagactgagagaaataactctacattcttccgtacagagcgctggttaggacaaaccggcaacgactctatgaaatataattataatggtatttcacaattttcatctattagaaatcgttcttcaagtcaagtgcttgatagacttggctttaaatcagatggtacaaatttaaatttacgttatcaaaataatactttgatcgcagatagtctatttggtgtgaagtataaccttacagaatatccttttgataaatttggttttatcaaaaaagctcaagataaacaaaccattctttacaaaaatcagtttgccagtcaattagctatactaacgaatcaagtatatcaagataaaccatttactgtgaatactttggataatcagacaactcttttaaatcaattaagtggtttgaaagagacgtattttgagcatcttattccaaatagcgtttctgggcaaaccactcttaataaacaagtatttgttaaaaagaataaacaagggaatactgaaattacctataacataactatccctaaaaacagtcagttatatgttagtatgccgtttataaattttaataatgaggaaaataaaattgttcaaatctccgttaataatggaccatttgtacctaatactcttgataatgcttattcattttttaatattggttcctttgctgaaaacagtcgtatcaaagtaaaatttcaatttccacacaatgatcaagtttctttcccaattcctcacttttatgggctcaagttagaagcttatcaaaaagctatgactgttattaataaacgaaaagtaaaagtaagaactgatcacaataaagttattgctaattatacaagtcctaatagaagttctcttttcttcactattccctatgataggggttggaaagcttatcaaaataataaagaaataaaaattttcaaagctcagaaaggttttatgaaaataaatattcctaaaggaaaaggcaaagtaacattaatttttatcccttacggctttaaatttggggtaggcctatctattactggaatagtattatttactgtctattattttaaatttggaaaaaataaaataggatgagagtattctcatcctattttattaacaaaaaaacgccgacaaatcaacgtttagatgtgtcttatcactccggcagcaggactcgaacctgcgacatcatgattaacagtcatgcgctactaccaactgagctatgccggataaataaaaaactgcaaagcagttatcaatagtccgtacgggattcgaacccgtgttaccgccgtgaaaaggcggtgtcttaaccccttgaccaacggaccataggttaggtgtttccttagtactcttaatattatatcagaaaaaaaaggtttgtctatacttttgttcaataatttttacaaaaaaattgaacctacttatgagcaaaaaaatatatttccaactcataaatagtacatatgaaaacttgacagcctgcctaatattttggtagaataacagagttgatggttccatagctcagctggatagagcattcgccttctaagcgaacggtcgcaggttcgaatcctgctggaatcagatattgaaagcctagatagattatctaggctttttatttgtttttagcagttgtttcataaatggaacgattatttgtggtaaggagtgccttgacgaatcataaaagcacgataaatttgttccatcaagactaatttcataagttgatgaggtaaggttaacagtccaaaactcattaaataatcagcacgttttttcactttttgagataaacccaaactaccaccaataacaaaagtaatagtagagtagccggatatcattttttgatcgattagatggctaaatgattcagatggcaattgtttcccttctatagctaaaccaatgacataatccctctcacctattttactcaaaatacgttccccttctatatctaaaattctttgattttcagatatactagctttatcaggtgtcttttcatcagctagctcaattgtctcaattttagaaaagcgattcagacgtttctgatactctgcaacaccttctttaaggtatttctctttcaattttccaactgtaattatttttaatttcatagctacattataacataatccacaatattttcacaatttatccacatgtttatccttacatatccccttattttataggtattctataactataatcaaggttatccacaagttgtggatatttcctttttttagcttttaaggtataattaagaagcttgtcataagattagtataaaaatttacggaggtagctatttgtgaaaaaaaaattagtctcatcacttctaaagtgttctctaatcattattgttagctttgctggtggagcatttgctagttttgtcatgaatcataatgacaatattccaaatggtggtgtcactaaaactagtaaagtaaattataataacataacgcctacaacaaaagctgttaaaaaggtacaaaatagtgttgtttctgttatcaattataaacaacaagagagtcgttctgacctatcagacttctatagtcatttttttggtaatcaggggggcaacactgataagggcttacaagtttacggtgaaggctctggagtcatctataaaaaagatggtaaaaatgcctatgttgtcactaataaccacgtcattgatggggctaaacaaattgaaattcaactagctgatggctcaaaagcagttgggaaacttgttgggtcagatacctactctgatttagccgtcgtcaaaattccatcagataaggtttcaaatattgcagaatttgctgattcatcaaaactcaacattggtgaaactgctatagcgatcggaagccctcttggaactgagtatgcaaattctgtaactcaaggtattgtatctagtttaaaaagaactgtaacaatgactaatgaagaaggacaaacagtttctacaaatgctatccagactgatgctgctatcaatcctggtaattcaggtggagcacttatcaatattgaaggacaggttattggaattaattctagtaaaatttcttctacatcaaatcaaacctcaggacaatcgtcaggaaatagcgttgaaggtatgggatttgccattccttcaaatgatgttgttaagattatcaatcaacttgagagtaacggacaagtagagagacctgctctaggtatttctatggctggattaagtaatttaccatccgatgttattagtaaactgaaaatcccaagtaatgttactaatggtattgtagtagcatctatccaatctggcatgccagctcaaggcaaactaaagaaatacgatgtcattactaaagttgacgataaagaagtagtatctccaagtgatttacaaagtttactctatggccaccaggtaggggattccataacagtaaccttttatcgtggtgaaaataaacaaacagtcactataaaacttactaaaactagtaaagatttagctaaacaacgagcaaataactaaatcaattctagttattttaactaagatatagtaaaattaaaggggttggtcagatagaccaatccctttagtaagtctatagaatctgaggtctaaaatggaatatttagaaacgatcaacatcaatcatattgctccaaatccgtatcaacctcgcctagaatttaatacaaaagaactagaagaattagccaactctattaaaattaatggccttatccaacccattattgtaagaccgtcagcagtctttggttacgaactggtagccggagaacgacggctaagagccgcaaagttagctaaattggaaagtatacctgcaattataaaatcctataataatgatgatagtatgcaattagctattgtcgaaaatttacaacgatctaatttgtcacctattgaagaggctaaagcctactctcaacttctacaaaagaaaagtatgacacatgaagagttagcaaaatatatgggaaaatctcgtccctatatatcaaatacgatacgactactaaatttaccgccactaattacttcagctattgaagaaggaaaactttcctctggtcatgcgcgtgcactactcagtctaccagatgctagtcaacagaaagattggtatcagagaatcctcactgaagatattagtgtaagacgactagagaagttattaaaacaagaaaagaaaacaaatcataagtcacttcaaaataaagatgtctttctaaaacatcaagaaaatgagttagctcaatttctaggtagcaaagtgaaacttactattaataaagatggtgctggcaatataaagattgctttcgctaaccaagaagaattaaacagaattatcaacactctaaaataagggtgttgattatttttttatttaatcaaacttatccacaaggtattttgctatttttctgttgattctctaatttccacagtctgtggaaaactttaattaacattgttgattttattcttcaacatctgtggaaaactttatttttttatggtacaatataacaataattatccacaagacaataaggaagaagctatgacggaaaacgaacaactattttggaatagagtactagagctatctcgttctcaaatagcaccagcagcttatgaattttttgttctagaggctagactcctcaaaattgaacatcaaactgcagttattactttagataacattgaaatgaaaaagctattctgggaacaaaatttggggcctgttatcctaacagctggttttgaaattttcaatgctgaaattacagctaactatgtctcaaacgatttacatttacaagaaactagtttttctaactaccagcaatctagcaatgaagtaaatactttaccaattagaaaaatcgactctaaccttaaagagaaatatacttttgctaattttgttcaaggagatgaaaatagatgggctgtttcagcatcaattgctgtagctgatagtcctggcacgacttataatcctctatttatctgggggggacctggtctaggaaagacgcatctactaaatgctattggaaatcaagtcttaagagataatccaaacgcgagggttttatacatcactgctgagaattttattaatgaatttgtcagtcatattcgtttagattcgatggaagaattaaaagaaaagtttcgcaacttagacttactcctgattgatgatattcagtcgcttgctaagaaaaccttaggggggacccaagaggagttcttcaatactttcaatgctttacatacaaacgataaacaaatcgtattgaccagtgaccgaaatccaaatcaattaaatgatctagaagaacgtctagtcacgcgctttagttggggactcccagtaaatatcacaccacctgattttgaaacacgagttgctattttaaccaataaaattcaagaatatccttatgattttcctcaagataccattgaatacttagcaggagaatttgattccaacgtacgtgaattagaaggagccttgaaaaatattagtctagttgctgactttaagcatgctaaaactattacagtagatatagctgcagaagctatcagagcacgtaaaaatgatggtcctattgttactgtcattcctatagaagaaattcaaatacaagttggtaaattctatggcgtaactgtaaaagagataaaagcaactaaaagaacacaagatattgtccttgcaagacaggtagccatgtacttagctcgtgagatgacagataacagtctcccaaaaataggtaaagaatttgggggacgagatcactcaactgttctccacgcttataataaaataaaaaatatggttgctcaagatgacaacttacgaattgagatagaaactatcaaaaataaaatcagataggctttgtggataagtatcagaaaaatacgagacttttccacaggttgtgaacaagttattttccttatgaatattaaagttataatacttattcacaactttaacaggacctactattactactaaatttatactaatatataaaggatatactatgattcatttttcaataaataaaaatttcttcttgcatgctctaacggtaaccaaacgagctattagtcataaaaatgcgattccaatcctttcaactgttaaaatagaagtgactagggatgctatcattttaacggggtcaaatggacaaatttcaattgaaaatactattcctgcttcaaatgaaaatgcaggtttactagtaacgaatccaggctctattttgttagaagctggtttctttattaatattatttcaagtttaccagatgtaactttagaatttacagagattgaacaacatcaaattgttcttactagtggaaaatcagagattactttgaaaggtaaggatgtcgatcaataccctcgtctgcaggaaatgacaacagatactccattaacattagaaactaaactgttaaaatcaattattaatgaaactgcttttgctgctagccaacaagaaagccgtccaatcttaacaggtgttcatttggttatcagtcaaaataaatactttaaggctgttgcgacagattcacaccgtatgagtcaacgcactttccaattagagaaatcggctaataattttgatttggttgttccaagtaaatcccttcgagaattttcggctgtttttacagatgatattgaaactgtagaggttttcttctcagatagtcaaatgttatttagaagtgaaaatatcagcttctatacacgtttgcttgaaggaaactaccctgatactgatcgcctcctaactaatcagtttgaaaccgaaattatctttaatacaaatgctttacgccatgctatggaacgtgcttatttaatttcgaatgcaactcagaacggtactgttcgtttagaaattcaaaatgagacagtctcagctcatgtaaactctccagaagttggtaaagttaatgaggaattggatactgttagtcttaaaggtgatagtttaaatattagctttaatccaacttacctaattgaatctttaaaagcagtaaaaagcgaaacagttacgattcgatttatttctccagtacgtccatttactttgacacctggtgaagatactgaagatttcatccaattaataactcctgttcgtactaactaaataagaaaactacccaagttattcttgggtagttttcttattctaagatatgctataatgatgagtaatatgactctatatataatagctaacccccatgctggtaataaaaatgcctccactattgttggtaaaattcaggagctttatcatactgaagatatttctgtgttctatacagaacagaaagatgatgaaaaaaaacaagtcattaatatactaaggtcttttaaagaaagtgatcatctaatgattataggaggagatggtaccttatcaaaagtaatgacttatctcccccaacatattccgtgcacttattatcctgttggttcgggaaatgattttgccagagctttgaaaattcctaacctcaaagaaacccttaccgctattcagacagaaagattaaaggaaattaattgctttatttatgataaagggctgattttgaatagtttagatttaggttttgcagcctatgtcgtttggaaagcatctaactctaaaataaaaaatattttgaatagatatcgtctaggaaaaataacttacattgttatagctatcaaatcattattacattcttctaaagtacaagtattagtggaaggagagacaggacagcagataaaactaaatgacctttattttttcgcattagcaaataacacttattttggaggtggcattactatttggcctaaagcaagtgctttaactgcagagttagatatggtttacgctaaagggcatacttttctaaaacgattaagtattttattatctttggtttttaaaaggcatactacctctaaaagtataaaacaccagactttcaaagctatgaccgtatattttcctaaaaatagtttgattgaaatagatggcgaaatagttgagttagatcagattagtttaaaatgtcaaaaaaggtatttatatatgtaaggagaaaagatgtatcaagttggatcacttgttgaaatgaaaaaacctcatgcttgtgtaattaaagaaactggtaaaaaggctaatcaatggaaggtactgagagtaggagctgatattaaaattcagtgtactaactgtcagcatgtgattatgatgagtcgttatgattttgagcgaaaattaaaaaaagtactgcaaccatgaaagtccttttaaacaaataattatagctatatttgcaaccaatactttcctaaataatgctagtatgccgttggaaaattagctattctaatgttatcgaaagaagaaaggtggtcattgacaatgacgaaagttgcagaacagttatttatttttcggtaagtcatatcaaaatgggaaaatggggataccacaccagatttggataatttaatcaggttagctgagatttttgacgtgagcttagatgaacatgttttagctaaaacaaatgaagttaaagttgaacgtatttatgaaaataaaccccttgatctacgaaaatacaataaaatttattggtttatttttcgaaatattattcgatctctactaattattttagctatattaactttcttataagctctaggtattccctttgtttcggagtggataatttaaatgaaggtgaaagagtggcataatgataagcaaatctgaaattttcttcttatcataccgctttttcttctattttttgatataatagtcttgattgaaatttgaatggagactcactaaatggctttaacagcaggtattgtaggcttaccaaatgttggtaaatcaactttatttaacgcaattacaaaagcaggagcagaagctgctaattatccttttgcgactattgatcccaatgttggtatggtagaagtaccagatgagcgtctacaaaaattgacagaattgattacgcctaaaaaaacagttccgacaacctttgaatttactgatattgcaggtattgttaaaggtgcttcgaagggggaaggtctaggtaataaatttttagctaatattcgtgaagtggatgctattgttcatgtggtacgtgcgtttgatgatgaaaatgttatgcgtgaacaaggtcgtgaggatgctttcgttgatcctatagcagatattgatactattaatcttgaattaatcttagctgatttagagtcaatcaataaacgttatgcgcgtgttgaaaaaatggcacgaactcaaaaagataaagaatcagtagcagagttcaatgttttacaaaagattaaacctgttttggaagatgggaaatcagctcgtaccattgagtttacagaagaggaagcaaaagttgttaaaggtctttttttattaacaactaaacctgttttatatgttgctaatgttgatgaggacaaagtagctgatcctgatgatatcgactatgttaatcaaattcgtgcatttgcagaaacagagaatgcagaagtagtcgtgatttctgctcgagctgaagaagaaatatctgaacttgatgatgaagataagttagaatttttagaagctattggattaacagaatctggtgttgataaattaacacgagctgcttatcatcttttaggccttggaacttactttactgctggtgaaaaagaggttcgcgcttggacgtttaagcgtggtataaaagctccacaagctgctagtattatccattcagattttgaaagaggttttattcgtgcagtaacgatgtcatatgatgaccttattcaatatggatctgaaaaagcagtaaaagaagctggccggttacgtgaagaaggaaaagagtatattgttcaagatggcgatatcatggaattccgtttcaatgtctagtaataaataatcgatttgttaacttttaggttaaggatattgttaatatccttaaccatttttgcgttttaatggagaagataatggtaaaaatgattgttggattaggaaatccaggaagtaaatataatgatacaaaacataatattggatttatggctgttgacagaattgtaaaagaccttgacgtcaactttacagaagataaaaattttaaagcagagataggtagtgattttatcaacggtgaaaaaatttattttatcaaaccgactacttttatgaataacagtggtattgctgtaaaagccctgcttacttactacaacatttctattaaggatatgattatcatatatgatgatttagacatggaagtcggtaaaatacgttttcgtcaaaaaggatctgctgggggacataatggtatcaagtctattattgctcatttaggtactcaagaatttgatcgtattaaagtaggtataggacgtccgaatggacgtatgacagttattaatcatgttctagggaaatttgataaaaatgatgaaattatgatattaaatacccttgataaggttgacaatgctgtcaattattatttacagacgaatgattttcaaaaaacaatgcagaaatacaacggtttaaaatgaatattatagaattatttagccaaaataaagtggtgcggacatggcactctggattagtaactaatagtcgccaattagttatggggttttcaggagcaagtaaagctattgccatagcatcagcctacgagaagttatctaaaaaaattatggtagtcactgccactcaaaccgattctgataaattatcaagtgatatatcaagtttaattggagaagataacgtttatcaattttttgctgatgacgttcctgcagcagagtttattttctcttcattagataaatcaatttcacgactcagtgccctgaggtttctaaaagatccagaaaaaaacggtgttttgattactagtatcagtggtttaaggttactattaccaaatccggaagttttctcgaaaagtcaatataagtttgaaatcggtcaagaatgttatttagataaattgtgtaagaacctagtcaatttaggttatcagaaagtttctcaagtatttagtcctggtgaatttagccaaagaggagatattttagatatttttgagatgacacaagaatatccttatcgcttggaattcttcggagatgaaatagatggcatcaggcagtttgatattgacactcaaaagtctcttaaacaattagagtcagtacagatttcgccagcagatgatattattttacaagatgcagatttcgagcgtgcaaagaaaaaacttgagggctatctagtaacagctagtgaggtacaacgcacctatttgagcgaggttttatctacaactgagaatcattttaagcactcagatattcgtcgttttctaagtatcttttatgaaaaagaatggggaatattagactatattcctgagggaactccactttttgttgatgattttcaaaaaattgtagatcgaaatgctaagttagatttagaaatagctagccttctgacggaagatttacaacaaggcaagtctcattctagtttgaactatttttcagatccttataagcaattaagacaataccaaccagcaaccttcttttcaaatttccacaaaggattaggaaatctgaaatttgataaacttcatcattttactcaatatggaatgcaagaattttttaatcaatttccattgttggtcgatgaaatcaatcgttataagaaatctggagcgacagtactgttgcaagtagattctcaaaaaggtttaaatctccttcaagaaaatttaaaagaatatgggttagatttaatcatttcagataaaaacgatatcgttcaaaaggagtcacaacttattgttgggcatctttcaaatggtttttattttgcagatgagaaaattgttctgattactgaacgtgagatttatcataggcgtgttaaaaggaaaattagacgcagtaatattagtaatgcagaacgtctaaaagattataatgaactttcagttggcgattatgttgttcataatgttcatggcgtaggaaaatttttaggtattgaaacaattgagatacaaggtattcatcgtgattatctgactattcaatatcaaaatgctgatcgtatctctatccccgtagaacaaattgaacttctaacaaaatatgtctctgcagatggcaaagagcctaaaattaatacgttaaatgatggtcgcttcaaaaaagcaaaacagagagttgcaaagcaagtagaagatattgctgatgatttgttgaaactttatgcagagcgtagtcaattacaaggatttgcattttctcctgacgataatatgcaaaatgactttgataatgattttgcatatgtagagacagaggatcaattgcggtctataaaagaaattaaacaggatatggaaggtaatcgtccgatggatcgattattggttggagacgttggttttggtaagacagaggttgctatgcgtgcggctttcaaagctgtcaatgaccataaacaagttgttgttttagtcccaacaacagttctagcccagcagcattttgaaaattttaaagaacgttttagcaattatcctgttacagttgatgtacttagtcgttttcgtagcaaaaaagaacaaacagatacactaaaaagattatctaagggccaagttgatattattattggaacacatcgacttctctctcaagatgttgtattttcggatttagggttaatagttattgatgaggaacagcgatttggtgtaaagcataaagaaaagttaaaagaattaaaaacaaaagttgatgtattaactttgacagcgaccccaatacctagaacattacatatgtcaatgcttggcattagagacttatcagtcattgaaacacctccaactaatcgttatcctgtgcagacttacgttttggagacaaatcctggtttagttagagaagctattattcgtgagatagacagaggaggacaggttttttatgtttacaataaagttgacactattgatcagaaagtttcagaacttcaggagttagtaccagaagctagtattggttttgttcatggtcaaatgtctgaaattcaattagaaaatacattaatagactttatcaatggagattacgatgttttagttgcaacgacaataattgagacaggagtcgatatttcaaatgttaataccctctttgttgaaaatgcagatcatatgggcttgtcaaccctttatcaattaagaggccgtgtgggtagaagtaatcgcattgcttatgcttaccttatgtacagacctgataaagttttaacagaaatttctgagaaaagactagatgcaatcaaagggtttacagaattgggatctggttttaaaatagcgatgcgtgatttatctatacgtggtgcaggaaatattttaggagcttcacaaagtggttttattgattcggttggattcgagatgtattcacagcttctagagcaagcgattgccaccaaacaagggaaatcattaattcgtcaaaaaggtaatgctgaattagccttacaaattgacgcctatttaccagcagaatatatatcagatgagcgccaaaaaatagaaatatataagcgtattcgtgaattagaaactagggctgattatgaagccttacaagatgagttaatagatcgttttggagaatatcctgatcaagttgcataccttttagaaataggacttttaaaagcttatctggaccttgcctttactgaattagtagaaagaaaaggtaatgaaataagcatcctatttgaaaaagcatctttgaagtattttttaactcaagattattttgaagcactatcaaaaactcaacttaaggctagaattagcgaaacaaatggtaagatggaagttgtttttaatatcaaacataagaaaaattatgaaattattgaagaacttctaaaatttgccgaatgttttatcgagattaagtcacgtaaaccagtagaagaataactaagtgaaaagttgcaaggaaatttggatactcttttagaaaatgtttggttcaagaagaatagtacgagcaacattatgtttcacgtcaaacatctcaacttttgaaagacataaatatttttagaggttattaaaatagaagttttttacttgatatttgagagaattaagagagctattagctctctttttgttacattatattgacaaatattatcagttcagatatttttcaaaaaaaatgctaaaatagtagagttaatttagatagaaggatgtgatcatcagtgagattagacaagtatctaaaagtgtcgcgtatcattaagcgtcgtcccgttgctaaagaagttgcagacaaaggacgtgtcaaggtgaatggcgtattagcaaagtcatcaactgacctaaagcttaatgaccaagttgaaattcgttttggtaataaattgttgaccgttaaagtattagaaatgaaagatagcactaagaaagaagatgctatcaaaatgtatgaaattattaatgaaacaaggatagaaacagatgagcaagcctaatgttgttcagttaaataatcaatatattaacgatgagaatctaaaaaaacgttacgaagctgaggagttacgccgaaaaaatcgtttaatgggttgggttcttatttttgtcatgcttttatttattttacccacttataatttagttaagagttacagaactttacaagaacgtcgtcaagaagttgtaaaattaacgaaagactatcagacattaactaatagaactgagaaccagaagttgctagcaaaacaactaaaaaatccagattacgttcaaaaatatgctcgagctaagtattatttctctaagaccggcgaaatgatttacccattaccagaccttttaccaaaataattatgaataatttaattgaaacaatagaacattttctagcctactcggatgacaaactagaagaattagctgataagaactatcaacttaggcaaacaattgtagaaaaagaaaagattgagagcagagaaaagtaatgaagaaagttttaaccttcttattatgtagcttatattttgtatcaatcccagctataagtaccgaggagccattaacgctttctcaaaatagacgatacgccttaactcagacagttgtggataaggaaatgtattttgatgctattccagagagaccaactacaaaaattgaaataagcagttttcaagatgaagctttaaccataacaggagagactttagttccaaatactttattgtcgattgtttctcttacaattaattcaaatggaattccagtatttactttgtccaatggacagttcataaaggctagtcgtgaagctatttttaatgatttagtttctaagcagcaatctgtctcattggattattggttaaaaccttcttttgtgacttatgaagcaccttacacaaatggtgttagtgaagttaaaaataatttaaaaccttattccagagtgcatttagtagaacaagcagaaacagaacatggtatttattataaaacggacagtggtttttggatatcagtagaagatctatcggttgctgataatcgtatggctaaggttcaagaagtattattggaaaaatataataaagataaatatggtatatacatcaaacaattaaatacacagacagtagctggtattaatattgataggtcaatgtactctgcaagtattgcaaaattagcaacactttatgctagccaagagcaagtaaaattaggaaaactgtcattggacagcaaatttgaatacaaagataatgttaatcaatttcctaatagctatgatccaagtggtagtgggaaattagagaaaaaagctgatcataaattatataccgttaaggagttacttgaagcaactgccaaggaatcagataatgttgcaacaaatatgctaggttattatgtcaataatcaatatgattcaatgtttcaaacacaagtagacacaatttctggtatgcactgggatatgaaaaaacgccagatttctccacaagctgcgggtaaaatgatggaagcaatttattatcaaaatggagatattgttaattacctatcaaagactgattttgataatacaagaatccctaaaaatataccagttaaagtagcacataaaattggagatgcttatgactacaaacatgatgcggctattgtttatgcagaacaaccttttattatgattatctttacggataaatcatcttacgatgatatcactaagattgctgacgacgtttaccaggttttaaaataatatgtataacactattttgaaagataccttatccaaagggttatttaccgctcatcagaaagttctaattgctgtttctggtggcattgattcaataaatttgttgcaatttttataccagtatcaaaaagagttatcgattagtattggtattgcacacataaatcatggacagcgaaaagaatcagaaaaagaagaagaatatatcagacagtggggacagatacatgatgtccctgtctttatctcttattttcaaggaatattttcagaagatagagcacgtaaccatcgctacaattttttttcaaaagttatgcgtgaagaaggttacacggctttagtaacagctcaccatgctgatgatcaagctgaaactgtatttatgagaattttaagaggaagcaggctacgctatttatcagggattaagcaagtgagtgcttttgcaaacggtcaattgattagaccatttcttccatataaaaaggagttattaccaaatatttttcattttgaagatgctagcaacgcttcgtctgattatttaagaaatcgaataagaaacgtctactttcctgctttggaaagagaaaataatcaattgaaagattctctcataactctctctgaggaaacagagtgtttattcacggctttaacagacctaacaaggagcatcgaagtaacaaactgctatgattttttaaggcaaactcattctgtccaagaatttttattgcaagattacattagcaaatttccagatttacaagtgagtaaagaacagttcagagtaatattaaaattgattagaactaaagccaatattgactatactattaaatcgggctattttcttcataaggattacgagagttttcatattacaaaaatccatcctaagacggatagttttaaggttgaaaaaagattagaattgcataatatacaaatattctcacaatatttattttcctatggaaaattcatttctcaagcagacattactattcctatttatgatacttctccgattattttaagaagaagaaaagaaggggataggatatttttaggaaatcacactaaaaaaattcgccgtctatttattgatgagaaaataactctaaaagagagagaagaagctgttattggggagcaaaataaagagttgatatttgtgattgttgcaggtagaacatatttgagaaaaccttctgaacatgatataatgaagggcaaactttatattgaaaatttagaaaaaaggtgacatcatgcttgaaaatgatataaaaaaagttttatattcagaagaagatattattctgaaaacgaaagaattaggagctaaattaactgcagattatgcaggtaagaatccattattagtaggtgtattaaaggggtcagtgccttttatggctgagctattaaagcatattgatacacatgttgaaattgattttatggttgtttcaagctatcatggtggtacaactagtagtggagaagttaaaattttaaaagatgttgatactaacattgaaggaagagatgtaatctttattgaagacatcattgatactggacgtacattaaaataccttcgagatatgtttaagtatcgccaagctaactctgtcaaagttgcaaccctttttgataagccagaagggcgattggtagatattgatgctgattacgtttgttacgatatcccaaatgaatttattgtgggattcggtttagactatgctgaaaactatcgtaacttaccttatgttggtgtgttaaaagaagaaatttactcaaaatagaaaaaaggtactctcttaaactatgaaaaataataaaaataatggttttctgaaaaattcctttatttacatattattgattattgcggttattacaacctttcaatactatttaaaaggaactagctctcaaaaccagcaaatttcttatacaaaacttgttaaacaattaaaagctggagaaattaagtctatctcataccagccaagtggtggtgttgttgaagttagtgggacatataagaaagccaaaacaattaaatcagctaatagttttacttttttaggtggtagtgttgctactaaagttacaggatttaattctgttatactaccaaatgactcttcaataaaatctcttgttagcgctgctgaagaaaataacactaatattcaggtcaaacatgaaagttcaagtgggacatggatttcttatattgccagttttttacctttagttatcatgattggtttcttcatgatgatgatgaaccaaggcggtggcggtggcgctcgtggtgccatgagctttggtaaaaataaagcaagatcatctagtaaagatgaggttaaagttcgattttcggatgttgctggagcagaggaagaaaagcaagaattaatagaagtcgttgacttccttaaagatcctaaacgatataaatctctaggtgcccgaattccagcaggggttctattagaaggacctccagggacaggtaaaaccctattagcaaaagctgttgccggtgaagcaggggttccattctttagtatttccggttcagattttgttgaaatgtttgtcggtgttggagctagtcgagtacgctctttgtttgaagatgctaaaaaagctgaacgtgctattattttcattgatgaaattgatgctgttggacgtcgacgtggagctggtatgggtggcggaaacgatgaacgtgaacaaacgctcaaccaacttttaattgaaatggatggttttgaaggaaacgaaagtattatcgttatcgctgctaccaaccgtagtgatgtgttagatcccgcattactgcgtccaggacgttttgatagaaaagttctagttggacaacctgatgtaaaaggtcgtgaagcaattctgagagtacatgctaaaaataaaccattagcagataatgttgacttaaaagtagtagctcaacaaaccccaggatttgttggtgctgatttggagaatgttctcaatgaagctgctttagttgctgcgcgacgaaataaaaaagttattgatgcttcagatattgatgaagcagaagaccgtgtaattgctggtccttctaaaaaagatcgtactatttctgaaagagaaagagctatggttgcttaccatgaagctgggcacacaattgtcggtttgattctttcaaatgcgcgagttgttcataaagttactatcgtaccacgtggtcgtgcaggtggatatatgattgctttacctaaagaagatcaaatgcttctttcaaaagatgatatgaaagagcaattagcaggtcttatgggaggacgtgtagcggaagaaattattttcaacgctcagacaacaggtgcctcaaatgacttcgaacaagccactgctatggcccgcgctatggtaactgaatatggtatgagcgagaaacttggaccagttcaatacgaaggcaaccacgcaatgatggctggtcaaatgtcacctgaaaaatcatattctgctcaaactgcacaacttattgatgatgaagttcgtcaccttcttaatgaagcacgtaataaggcagctgatattatcaacgaaaaccgtgatactcataaattaattgcagaagccctcttaaaatatgagactcttgatgctgctcagattaaatcgatttttgagacaggtaaaatgcctgagacagaaaatgatgaagataaagcaagagcgttatcatacgatgaaatcaaagaaaaaatgcaagaagaagataaaaaataagtcatcatatatttttaaagaactttataaatttcaaatacccttcaaatttagataaaatttgaagggtattttttatgaagatgaagtttaaatttgtgaattaagaagatgaaatatgaacatgacaacggtaaaaatgctatccattcaacaagtatagaaggttagttactataaataatattaactttttaaaaataaaagaaaaaatgcaaaaatagtattgacaggaagtagaaatatttagtataatgaataagttgtctcgagagagcagcttctagtaacgcgtagttaacaacttaaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgtagactcgttagctcagttggtagagcaattgacttttaatcaatgggtcactggttcgagcccagtacgggtcatttagaaatgcgggtgtggcggaattggcagacgcaccagatttaggatctggcgcttaacggcgtgggggttcaagtcccttcacccgcattagtagattgccggcttagctcagttggtagagcatctgatttgtaatcagagggtcgcgtgttcaagtcatgtagccggcattacaattttataggataaatagtgtctttagtgcgaacgtagttcagtggtagaacatcaccttgccaaggtgagggtcgcgggttcgaaccccgtcgttcgcttgttagaggccggggtggcggaactggcagacgcacaggacttaaaatcctgcgatggtaaacatcgtaccggttcgattccggtcctcggcatataatatttagcacccttagctcaactggatagagtacctgactacgaatcaggcggttagaggttcgactcctctagggtgcatatttttcgggaagtagctcagcttggtagagtacttggtttgggaccaaggtgtcgcaggttcgaatcctgtcttcccgatggatatatttttatgatatatcattagacctttgaaaactgaacaagacgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgtagactcgttagctcagttggtagagcaattgacttttaatcaatgggtcactggttcgagcccagtacgggtcatttagaaatgcgggtgtggcggaattggcagacgcaccagatttaggatctggcgcttaacggcgtgggggttcaagtcccttcacccgcattagtagattgccggcttagctcagttggtagagcatctgatttgtaatcagagggtcgcgtgttcaagtcatgtagccggcattacaattttataggataaatagtgtctttagtgcgaacgtagttcagtggtagaacatcaccttgccaaggtgagggtcgcgggttcgaaccccgtcgttcgcttgttagaggccggggtggcggaactggcagacgcacaggacttaaaatcctgcgatggtaaacatcgtaccggttcgattccggtcctcggcatataatatttagcacccttagctcaactggatagagtacctgactacgaatcaggcggttagaggttcgactcctctagggtgcatatttttcgggaagtagctcagcttggtagagtacttggtttgggaccaaggtgtcgcaggttcgaatcctgtcttcccgatggatatatttttatggcggtgtagctcagctggctagagcgtccggttcatacccgggaggtcgggggttcgatcccctccgccgctatttattttattgagactttggacctttagctcaactggttagagcactcggctcataaccgagcggtcgtaggttcgagtcctacaaggtccatattttttgttatatggaggattacccaagtccggctgaagggaacggtcttgaaaaccgtcaggcgtgtaaaagcgtgcgtgggttcgaatcccacatcctcctttaaagatatcgcgggatggagcagctaggtagctcgtcgggctcataacccgaaggtcgtaggttcaaatcctgctcccgcaataggctcggtagctcagttggtagagcaatggattgaagctccatgtgtcggcggttcgattccgtctcgcgccatttattatataagtttttagcgggtgtagtttagtggtaaaactacagccttccaagctgttgtcgcgagttcgattctcgtcacccgcttactttacataaaagtaaaaccaagcatttgcttgggcgcgtagctcaggtggttagagcgcacgcctgataagcgtgaggtcggtggttcgagtccactcgtgcccattaatattaatttggagaattactcaagaggctgaagaggacggtttgctaaatcgttaggtcgggtaactggcgcaagggttcgaatcccttattctccgtaaatattataattttaagagtaattatactctttttttatttctcttttagtttcactatggagtaattatattgatagagtgaatagaagaaggttatcgttttctagatttgattatg

SEQ ID NO: 10968 - DNA, 50 bp, Artificial Sequence
  Amplification primer (forwards)
ggggacaagtttgtacaaaaaagcaggctctcaatctcatattgtttcag

SEQ ID NO: 10969 - DNA, 52 bp, Artificial Sequence
  Amplification primer (forwards)
ggggacaagtttgtacaaaaaagcaggctctaattacattattacatttttg

SEQ ID NO: 10970 - DNA, 51 bp, Artificial Sequence
  Amplification primer (forwards)
ggggacaagtttgtacaaaaaagcaggctctgatactagttcaggaatatc

SEQ ID NO: 10971 - DNA, 52 bp, Artificial Sequence
  Amplification primer (forwards)
ggggacaagtttgtacaaaaaagcaggctctgatacaagtgataagaatact

SEQ ID NO: 10972 - DNA, 50 bp, Artificial Sequence
  Amplification primer (forwards)
ggggacaagtttgtacaaaaaagcaggctctatttttcttcatagtccac

SEQ ID NO: 10973 - DNA, 50 bp, Artificial Sequence
  Amplification primer (forwards)
ggggacaagtttgtacaaaaaagcaggctctgaatgggtgttattaactc

SEQ ID NO: 10974 - DNA, 51 bp, Artificial Sequence
  Amplification primer (forwards)
ggggacaagtttgtacaaaaaagcaggctctacaaattcttattttagcaa

SEQ ID NO: 10975 - DNA, 47 bp, Artificial Sequence
  Amplification primer (forwards)
ggggacaagtttgtacaaaaaagcaggctctgtatcagttcaggcgt

SEQ ID NO: 10976 - DNA, 47 bp, Artificial Sequence
  Amplification primer (forwards)
ggggacaagtttgtacaaaaaagcaggctctgctgctctaggacaac

SEQ ID NO: 10977 - DNA, 48 bp, Artificial Sequence
  Amplification primer (forwards)
ggggacaagtttgtacaaaaaagcaggctcttttgttgttgccttatt

SEQ ID NO: 10978 - DNA, 46 bp, Artificial Sequence
  Amplification primer (forwards)
ggggacaagtttgtacaaaaaagcaggctctccacctatggaacgt

SEQ ID NO: 10979 - DNA, 47 bp, Artificial Sequence
  Amplification primer (forwards)
ggggacaagtttgtacaaaaaagcaggctctcagaaagtctatcggg

SEQ ID NO: 10980 - DNA, 49 bp, Artificial Sequence
  Amplification primer (forwards)
ggggacaagtttgtacaaaaaagcaggctctagtgagaagaaagcaaat

SEQ ID NO: 10981 - DNA, 48 bp, Artificial Sequence
  Amplification primer (forwards)
ggggacaagtttgtacaaaaaagcaggctcttcttggaattattggag

SEQ ID NO: 10982 - DNA, 48 bp, Artificial Sequence
  Amplification primer (forwards)
ggggacaagtttgtacaaaaaagcaggctctgcaatgattgtaaccat

SEQ ID NO: 10983 - DNA, 48 bp, Artificial Sequence
  Amplification primer (forwards)
ggggacaagtttgtacaaaaaagcaggctctgcatcttataccgtgaa

SEQ ID NO: 10984 - DNA, 46 bp, Artificial Sequence
  Amplification primer (forwards)
ggggacaagtttgtacaaaaaagcaggctctgccgagaaggataaa

SEQ ID NO: 10985 - DNA, 51 bp, Artificial Sequence
  Amplification primer (forwards)
ggggacaagtttgtacaaaaaagcaggctctgtttataaagttattcaaaa

SEQ ID NO: 10986 - DNA, 48 bp, Artificial Sequence
  Amplification primer (forwards)
ggggacaagtttgtacaaaaaagcaggctctaagcctaacagtcaaca

SEQ ID NO: 10987 - DNA, 50 bp, Artificial Sequence
  Amplification primer (forwards)
ggggacaagtttgtacaaaaaagcaggctctgatgataactttgaaatgc

SEQ ID NO: 10988 - DNA, 47 bp, Artificial Sequence
  Amplification primer (forwards)
ggggacaagtttgtacaaaaaagcaggctctgcagtgattgcaagtc

SEQ ID NO: 10989 - DNA, 43 bp, Artificial Sequence
  Amplification primer (forwards)
ggggacaagtttgtacaaaaaagcaggctgtgctgcatcaaac

SEQ ID NO: 10990 - DNA, 43 bp, Artificial Sequence; identical to SEQ ID NO: 10989
  Amplification primer (forwards)

SEQ ID NO: 10991 - DNA, 46 bp, Artificial Sequence
  Amplification primer (forwards)
ggggacaagtttgtacaaaaaagcaggctgtactaaacaaagccag

SEQ ID NO: 10992 - DNA, 45 bp, Artificial Sequence
  Amplification primer (forwards)
ggggacaagtttgtacaaaaaagcaggctgtcaattaaccgatac

SEQ ID NO: 10993 - DNA, 44 bp, Artificial Sequence
  Amplification primer (forwards)
ggggacaagtttgtacaaaaaagcaggctgctcaaatgattcat

SEQ ID NO: 10994 - DNA, 52 bp, Artificial Sequence
  Amplification primer (forwards)
ggggacaagtttgtacaaaaaagcaggctctaaaagttcacaagttactact

SEQ ID NO: 10995 - DNA, 51 bp, Artificial Sequence
  Amplification primer (forwards)
ggggacaagtttgtacaaaaaagcaggctctagtcattattccataaaatt

SEQ ID NO: 10996 - DNA, 49 bp, Artificial Sequence
  Amplification primer (forwards)
ggggacaagtttgtacaaaaaagcaggctctaatcatatgctgattgag

SEQ ID NO: 10997 - DNA, 45 bp, Artificial Sequence
  Amplification primer (forwards)
ggggacaagtttgtacaaaaaagcaggctcagtttggatgttaac

SEQ ID NO: 10998 - DNA, 44 bp, Artificial Sequence
  Amplification primer (forwards)
ggggacaagtttgtacaaaaaagcaggctcaacaaatgcagatg

SEQ ID NO: 10999 - DNA, 48 bp, Artificial Sequence
  Amplification primer (forwards)
ggggacaagtttgtacaaaaaagcaggctgttttgtcattattgatag

SEQ ID NO: 11000 - DNA, 51 bp, Artificial Sequence
  Amplification primer (forwards)
ggggacaagtttgtacaaaaaagcaggctctctaacttggtttttattaga

SEQ ID NO: 11001 - DNA, 49 bp, Artificial Sequence
  Amplification primer (forwards)
ggggacaagtttgtacaaaaaagcaggctctggtttaaaagtgactgaa

SEQ ID NO: 11002 - DNA, 49 bp, Artificial Sequence
  Amplification primer (forwards)
ggggacaagtttgtacaaaaaagcaggctctcatcatttaggtaaggaa

SEQ ID NO: 11003 - DNA, 50 bp, Artificial Sequence
  Amplification primer (forwards)
ggggacaagtttgtacaaaaaagcaggctctgttagtaatcgctacaatc

SEQ ID NO: 11004 - DNA, 48 bp, Artificial Sequence
  Amplification primer (forwards)
ggggacaagtttgtacaaaaaagcaggctctaatcaagaagtttcagc

SEQ ID NO: 11005 - DNA, 47 bp, Artificial Sequence
  Amplification primer (forwards)
ggggacaagtttgtacaaaaaagcaggctctcgagttttagcggata

SEQ ID NO: 11006 - DNA, 51 bp, Artificial Sequence
  Amplification primer (forwards)
ggggacaagtttgtacaaaaaagcaggctctgtattattttaccaatcaca

SEQ ID NO: 11007 - DNA, 46 bp, Artificial Sequence
  Amplification primer (forwards)
ggggacaagtttgtacaaaaaagcaggcttaggagtggtagttcat

SEQ ID NO: 11008 - DNA, 48 bp, Artificial Sequence
  Amplification primer (forwards)
ggggacaagtttgtacaaaaaagcaggctttttattgttagtattagc

SEQ ID NO: 11009 - DNA, 49 bp, Artificial Sequence
  Amplification primer (forwards)
ggggacaagtttgtacaaaaaagcaggctctgtttatctagcggttaga

SEQ ID NO: 11010 - DNA, 50 bp, Artificial Sequence
  Amplification primer (forwards)
ggggacaagtttgtacaaaaaagcaggctataacagtttagttagaagtc

SEQ ID NO: 11011 - DNA, 47 bp, Artificial Sequence
  Amplification primer (forwards)
ggggacaagtttgtacaaaaaagcaggctttaaagggtttacatatt

SEQ ID NO: 11012 - DNA, 45 bp, Artificial Sequence
  Amplification primer (forwards)
ggggacaagtttgtacaaaaaagcaggctttaatacaattggtcg

SEQ ID NO: 11013 - DNA, 49 bp, Artificial Sequence
  Amplification primer (forwards)
ggggacaagtttgtacaaaaaagcaggctctatggaaaaaattaggatt

SEQ ID NO: 11014 - DNA, 49 bp, Artificial Sequence
  Amplification primer (forwards)
ggggacaagtttgtacaaaaaagcaggctctagagatgagcaagaaata

SEQ ID NO: 11015 - DNA, 51 bp, Artificial Sequence
  Amplification primer (forwards)
ggggacaagtttgtacaaaaaagcaggctctcaacagataggtctttataa

SEQ ID NO: 11016 - DNA, 49 bp, Artificial Sequence
  Amplification primer (forwards)
ggggacaagtttgtacaaaaaagcaggctttctctataattacttcaat

SEQ ID NO: 11017 - DNA, 50 bp, Artificial Sequence
  Amplification primer (forwards)
ggggacaagtttgtacaaaaaagcaggctctaataaggcattattagagg

SEQ ID NO: 11018 - DNA, 51 bp, Artificial Sequence
  Amplification primer (forwards)
ggggacaagtttgtacaaaaaagcaggctctacacatttagttgacttaac

SEQ ID NO: 11019 - DNA, 52 bp, Artificial Sequence
  Amplification primer (forwards)
ggggacaagtttgtacaaaaaagcaggctctagtaaacaacacatttatcta

SEQ ID NO: 11020 - DNA, 49 bp, Artificial Sequence
  Amplification primer (forwards)
ggggacaagtttgtacaaaaaagcaggctctcaagaaactcatcagttg

SEQ ID NO: 11021 - DNA, 49 bp, Artificial Sequence
  Amplification primer (forwards)
ggggacaagtttgtacaaaaaagcaggctctgcagaagacattgttaca

SEQ ID NO: 11022 - DNA, 48 bp, Artificial Sequence
  Amplification primer (forwards)
ggggacaagtttgtacaaaaaagcaggctataatttttcgactaatga

SEQ ID NO: 11023 - DNA, 49 bp, Artificial Sequence
  Amplification primer (forwards)
ggggacaagtttgtacaaaaaagcaggctctgacacagtgtcttatcct

SEQ ID NO: 11024 - DNA, 47 bp, Artificial Sequence
  Amplification primer (forwards)
ggggacaagtttgtacaaaaaagcaggctctgtggagcaagtggcca

SEQ ID NO: 11025 - DNA, 51 bp, Artificial Sequence
  Amplification primer (forwards)
ggggacaagtttgtacaaaaaagcaggctctcaagaactaagtaactttga

SEQ ID NO: 11026 - DNA, 48 bp, Artificial Sequence
  Amplification primer (forwards)
ggggacaagtttgtacaaaaaagcaggctctactgaaacgtttgaagg

SEQ ID NO: 11027 - DNA, 48 bp, Artificial Sequence
  Amplification primer (forwards)
ggggacaagtttgtacaaaaaagcaggctctgatgaagcaacaactaa

SEQ ID NO: 11028 - DNA, 52 bp, Artificial Sequence
  Amplification primer (forwards)
ggggacaagtttgtacaaaaaagcaggctctaataaagataatcaaaaaact

SEQ ID NO: 11029 - DNA, 46 bp, Artificial Sequence
  Amplification primer (forwards)
ggggacaagtttgtacaaaaaagcaggctgtttcttttttattcca

SEQ ID NO: 11030 - DNA, 48 bp, Artificial Sequence
  Amplification primer (forwards)
ggggacaagtttgtacaaaaaagcaggctattactttgatggtagttt

SEQ ID NO: 11031 - DNA, 48 bp, Artificial Sequence
  Amplification primer (forwards)
ggggacaagtttgtacaaaaaagcaggctctgttcaatcattagcaaa

SEQ ID NO: 11032 - DNA, 49 bp, Artificial Sequence
  Amplification primer (forwards)
ggggacaagtttgtacaaaaaagcaggctttaaaggtaataagaagttg

SEQ ID NO: 11033 - DNA, 50 bp, Artificial Sequence
  Amplification primer (forwards)
ggggacaagtttgtacaaaaaagcaggctctagtcaagttgactctgtta

SEQ ID NO: 11034 - DNA, 47 bp, Artificial Sequence
  Amplification primer (forwards)
ggggacaagtttgtacaaaaaagcaggctctcaaaaccaggtgactg

SEQ ID NO: 11035 - DNA, 48 bp, Artificial Sequence
  Amplification primer (forwards)
ggggacaagtttgtacaaaaaagcaggcttaagattttataacaacga

SEQ ID NO: 11036 - DNA, 47 bp, Artificial Sequence
  Amplification primer (forwards)
ggggacaagtttgtacaaaaaagcaggctctaatgttttaggggaaa

SEQ ID NO: 11037 - DNA, 44 bp, Artificial Sequence
  Amplification primer (forwards)
ggggacaagtttgtacaaaaaagcaggctcccaaaagacttttg

SEQ ID NO: 11038 - DNA, 44 bp, Artificial Sequence; identical to SEQ ID NO: 11037
  Amplification primer (forwards)

SEQ ID NO: 11039 - DNA, 48 bp, Artificial Sequence
  Amplification primer (forwards)
ggggacaagtttgtacaaaaaagcaggctctaaagttttagcctttga

SEQ ID NO: 11040 - DNA, 44 bp, Artificial Sequence
  Amplification primer (forwards)
ggggacaagtttgtacaaaaaagcaggctctgaaatggctttag

SEQ ID NO: 11041 - DNA, 53 bp, Artificial Sequence
  Amplification primer (forwards)
ggggacaagtttgtacaaaaaagcaggctctactaacttattgagtagaatca

SEQ ID NO: 11042 - DNA, 46 bp, Artificial Sequence
  Amplification primer (forwards)
ggggacaagtttgtacaaaaaagcaggctgtagctcaaaatctcat

SEQ ID NO: 11043 - DNA, 52 bp, Artificial Sequence
  Amplification primer (forwards)
ggggacaagtttgtacaaaaaagcaggctctagtttatctattaaagatgcc

SEQ ID NO: 11044 - DNA, 47 bp, Artificial Sequence
  Amplification primer (forwards)
ggggacaagtttgtacaaaaaagcaggctctatcaaagaggcggtaa

SEQ ID NO: 11045 - DNA, 50 bp, Artificial Sequence
  Amplification primer (forwards)
ggggacaagtttgtacaaaaaagcaggctctaaagaggataaaaagctag

SEQ ID NO: 11046 - DNA, 50 bp, Artificial Sequence
  Amplification primer (forwards)
ggggacaagtttgtacaaaaaagcaggctctagtgtttcaggtagtagtg

SEQ ID NO: 11047 - DNA, 50 bp, Artificial Sequence
  Amplification primer (forwards)
ggggacaagtttgtacaaaaaagcaggctctaaaaaattaaaacactcaa

SEQ ID NO: 11048 - DNA, 50 bp, Artificial Sequence
  Amplification primer (forwards)
ggggacaagtttgtacaaaaaagcaggctctgatgaagttacaacttcag

SEQ ID NO: 11049 - DNA, 48 bp, Artificial Sequence
  Amplification primer (forwards)
ggggacaagtttgtacaaaaaagcaggcttattccaaagtaaaataaa

SEQ ID NO: 11050 - DNA, 56 bp, Artificial Sequence
  Amplification primer (forwards)
ggggacaagtttgtacaaaaaagcaggctctcataaccatcactcagaacacatgt

SEQ ID NO: 11051 - DNA, 48 bp, Artificial Sequence
  Amplification primer (forwards)
ggggacaagtttgtacaaaaaagcaggctctcccaagaataggataaa

SEQ ID NO: 11052 - DNA, 50 bp, Artificial Sequence
  Amplification primer (forwards)
ggggacaagtttgtacaaaaaagcaggctctagtcagtatgagtcacaga

SEQ ID NO: 11053 - DNA, 48 bp, Artificial Sequence
  Amplification primer (forwards)
ggggacaagtttgtacaaaaaagcaggctctgcagaagtgtcacaaga

SEQ ID NO: 11054 - DNA, 45 bp, Artificial Sequence
  Amplification primer (forwards)
ggggacaagtttgtacaaaaaagcaggctcttttgatggattttt

SEQ ID NO: 11055 - DNA, 48 bp, Artificial Sequence
  Amplification primer (forwards)
ggggacaagtttgtacaaaaaagcaggctctacaaatgaaaaacgaac

SEQ ID NO: 11056 - DNA, 52 bp, Artificial Sequence
  Amplification primer (forwards)
ggggacaagtttgtacaaaaaagcaggctctgaaattaaactcaaaaatatt

SEQ ID NO: 11057 - DNA, 50 bp, Artificial Sequence
  Amplification primer (forwards)
ggggacaagtttgtacaaaaaagcaggctctcatactcaagaacacaaaa

SEQ ID NO: 11058 - DNA, 51 bp, Artificial Sequence
  Amplification primer (forwards)
ggggacaagtttgtacaaaaaagcaggctctcctaagaagaaatcagatac

SEQ ID NO: 11059 - DNA, 50 bp, Artificial Sequence
  Amplification primer (forwards)
ggggacaagtttgtacaaaaaagcaggctctgcagaactaactcttttaa

SEQ ID NO: 11060 - DNA, 51 bp, Artificial Sequence
  Amplification primer (forwards)
ggggacaagtttgtacaaaaaagcaggctctgcggatacatataataacta

SEQ ID NO: 11061 - DNA, 46 bp, Artificial Sequence
  Amplification primer (forwards)
ggggacaagtttgtacaaaaaagcaggctcttaccaaaaaatgacg

SEQ ID NO: 11062 - DNA, 48 bp, Artificial Sequence
  Amplification primer (forwards)
ggggacaagtttgtacaaaaaagcaggctctgaagagcttaccaaaac

SEQ ID NO: 11063 - DNA, 51 bp, Artificial Sequence
  Amplification primer (forwards)
ggggacaagtttgtacaaaaaagcaggctctagatatacaaatggaaattt

SEQ ID NO: 11064 - DNA, 50 bp, Artificial Sequence
  Amplification primer (forwards)
ggggacaagtttgtacaaaaaagcaggctctaaaaaaggacaagtaaatg

SEQ ID NO: 11065 - DNA, 50 bp, Artificial Sequence
  Amplification primer (forwards)
ggggacaagtttgtacaaaaaagcaggctctgattctgtcataaataagc

SEQ ID NO: 11066 - DNA, 47 bp, Artificial Sequence
  Amplification primer (forwards)
ggggacaagtttgtacaaaaaagcaggctctgaattttcacgagaaa

SEQ ID NO: 11067 - DNA, 48 bp, Artificial Sequence
  Amplification primer (forwards)
ggggacaagtttgtacaaaaaagcaggctaccaattaggtagctataa

SEQ ID NO: 11068 - DNA, 51 bp, Artificial Sequence
  Amplification primer (forwards)
ggggacaagtttgtacaaaaaagcaggctctgttaatacaaaaacacttct

SEQ ID NO: 11069 - DNA, 50 bp, Artificial Sequence
  Amplification primer (forwards)
ggggacaagtttgtacaaaaaagcaggctctggtcagtctaaaaatgaag

SEQ ID NO: 11070 - DNA, 47 bp, Artificial Sequence
  Amplification primer (forwards)
ggggacaagtttgtacaaaaaagcaggctctagccaggaggtatatg

SEQ ID NO: 11071 - DNA, 50 bp, Artificial Sequence
  Amplification primer (forwards)
ggggacaagtttgtacaaaaaagcaggctctgaaactattaatccagaaa

SEQ ID NO: 11072 - DNA, 49 bp, Artificial Sequence
  Amplification primer (forwards)
ggggacaagtttgtacaaaaaagcaggctctacaagtatgaaccatcaa

SEQ ID NO: 11073 - DNA, 47 bp, Artificial Sequence
  Amplification primer (forwards)
ggggacaagtttgtacaaaaaagcaggctctaaggggccaaaagtag

SEQ ID NO: 11074 - DNA, 54 bp, Artificial Sequence
  Amplification primer (forwards)
ggggacaagtttgtacaaaaaagcaggctctattactttagaaaaatttataga

SEQ ID NO: 11075 - DNA, 47 bp, Artificial Sequence
  Amplification primer (forwards)
ggggacaagtttgtacaaaaaagcaggctctgccttttactttggca

SEQ ID NO: 11076 - DNA, 48 bp, Artificial Sequence
  Amplification primer (forwards)
ggggacaagtttgtacaaaaaagcaggctctattttttccttgatcat

SEQ ID NO: 11077 - DNA, 47 bp, Artificial Sequence
  Amplification primer (forwards)
ggggacaagtttgtacaaaaaagcaggctctggtgaaacccaagata

SEQ ID NO: 11078 - DNA, 45 bp, Artificial Sequence
  Amplification primer (forwards)
ggggacaagtttgtacaaaaaagcaggcttaacaattcatggacc

SEQ ID NO: 11079 - DNA, 45 bp, Artificial Sequence; identical to SEQ ID NO: 11078
  Amplification primer (forwards)

SEQ ID NO: 11080 - DNA, 47 bp, Artificial Sequence
  Amplification primer (forwards)
ggggacaagtttgtacaaaaaagcaggctctcaaggacctcccggtg

SEQ ID NO: 11081 - DNA, 48 bp, Artificial Sequence
  Amplification primer (forwards)
ggggacaagtttgtacaaaaaagcaggctctcaaaatcaaaattcaca

SEQ ID NO: 11082 - DNA, 47 bp, Artificial Sequence
  Amplification primer (forwards)
ggggacaagtttgtacaaaaaagcaggctctctggagccttttattt

SEQ ID NO: 11083 - DNA, 49 bp, Artificial Sequence
  Amplification primer (forwards)
ggggacaagtttgtacaaaaaagcaggctctggtaatcgttcagataag

SEQ ID NO: 11084 - DNA, 47 bp, Artificial Sequence
  Amplification primer (forwards)
ggggacaagtttgtacaaaaaagcaggctctatccagcagatcaact

SEQ ID NO: 11085 - DNA, 47 bp, Artificial Sequence
  Amplification primer (forwards)
ggggacaagtttgtacaaaaaagcaggctctaaacgggttcgctatg

SEQ ID NO: 11086 - DNA, 50 bp, Artificial Sequence
  Amplification primer (forwards)
ggggacaagtttgtacaaaaaagcaggctctgtaaaattagtattcgcac

SEQ ID NO: 11087 - DNA, 48 bp, Artificial Sequence
  Amplification primer (forwards)
ggggacaagtttgtacaaaaaagcaggctctgttagcgttgataaggc

SEQ ID NO: 11088 - DNA, 50 bp, Artificial Sequence
  Amplification primer (forwards)
ggggacaagtttgtacaaaaaagcaggctctacaattaaaaatctcactg

SEQ ID NO: 11089 - DNA, 52 bp, Artificial Sequence
  Amplification primer (forwards)
ggggacaagtttgtacaaaaaagcaggctctagtaaaatcaaaattgtaacg

SEQ ID NO: 11090 - DNA, 50 bp, Artificial Sequence
  Amplification primer (forwards)
ggggacaagtttgtacaaaaaagcaggctctaatcttttaattatgggtt

SEQ ID NO: 11091 - DNA, 48 bp, Artificial Sequence
  Amplification primer (forwards)
ggggacaagtttgtacaaaaaagcaggctttcaatactatttaaaagg

SEQ ID NO: 11092 - DNA, 47 bp, Artificial Sequence
  Amplification primer (forwards)
ggggacaagtttgtacaaaaaagcaggctctaccgaggagccattaa

SEQ ID NO: 11093 - DNA, 49 bp, Artificial Sequence
  Amplification primer (forwards)
ggggacaagtttgtacaaaaaagcaggctctgaacaatcacaaaaaaca

SEQ ID NO: 11094 - DNA, 47 bp, Artificial Sequence
  Amplification primer (forwards)
ggggacaagtttgtacaaaaaagcaggctctatggtgacggtgctgg

SEQ ID NO: 11095 - DNA, 47 bp, Artificial Sequence
  Amplification primer (forwards)
ggggacaagtttgtacaaaaaagcaggctctagtcagccggtagggg

SEQ ID NO: 11096 - DNA, 47 bp, Artificial Sequence
  Amplification primer (forwards)
ggggacaagtttgtacaaaaaagcaggctctggtggagcatttgcta

SEQ ID NO: 11097 - DNA, 52 bp, Artificial Sequence; identical to SEQ ID NO: 11028
  Amplification primer (forwards)

SEQ ID NO: 11098 - DNA, 47 bp, Artificial Sequence
  Amplification primer (forwards)
ggggacaagtttgtacaaaaaagcaggctctgctgccaccaagaaag

SEQ ID NO: 11099 - DNA, 48 bp, Artificial Sequence
  Amplification primer (forwards)
ggggacaagtttgtacaaaaaagcaggctctacaacaaatgtaatggc

SEQ ID NO: 11100 - DNA, 46 bp, Artificial Sequence
  Amplification primer (forwards)
ggggacaagtttgtacaaaaaagcaggctcaatgaatttttcattt

SEQ ID NO: 11101 - DNA, 49 bp, Artificial Sequence
  Amplification primer (forwards)
ggggacaagtttgtacaaaaaagcaggctctacaaaatatcagcgaatg

SEQ ID NO: 11102 - DNA, 48 bp, Artificial Sequence
  Amplification primer (forwards)
ggggacaagtttgtacaaaaaagcaggctctactaagcaagcaatgtc

SEQ ID NO: 11103 - DNA, 52 bp, Artificial Sequence
  Amplification primer (forwards)
ggggacaagtttgtacaaaaaagcaggctctacaaaagaatatcaaaattat

SEQ ID NO: 11104 - DNA, 45 bp, Artificial Sequence
  Amplification primer (forwards)
ggggacaagtttgtacaaaaaagcaggctcgactaattcgttaaa

SEQ ID NO: 11105 - DNA, 47 bp, Artificial Sequence
  Amplification primer (forwards)
ggggacaagtttgtacaaaaaagcaggctttgaaatagtattggaaa

SEQ ID NO: 11106 - DNA, 54 bp, Artificial Sequence
  Amplification primer (forwards)
ggggacaagtttgtacaaaaaagcaggctctatattttctattttttattatgt

SEQ ID NO: 11107 - DNA, 49 bp, Artificial Sequence
  Amplification primer (forwards)
ggggacaagtttgtacaaaaaagcaggctctaaaaaacaacttcacaac

SEQ ID NO: 11108 - DNA, 51 bp, Artificial Sequence
  Amplification primer (forwards)
ggggacaagtttgtacaaaaaagcaggctctaaaacagatattgaaatagc

SEQ ID NO: 11109 - DNA, 51 bp, Artificial Sequence
  Amplification primer (forwards)
ggggacaagtttgtacaaaaaagcaggctctattaaatattatcatttgca

SEQ ID NO: 11110 - DNA, 47 bp, Artificial Sequence
  Amplification primer (forwards)
ggggacaagtttgtacaaaaaagcaggctctgctttacggaaccttg

SEQ ID NO: 11111 - DNA, 52 bp, Artificial Sequence
  Amplification primer (forwards)
ggggacaagtttgtacaaaaaagcaggctctactatttctcaacaacaatac

SEQ ID NO: 11112 - DNA, 51 bp, Artificial Sequence
  Amplification primer (forwards)
ggggacaagtttgtacaaaaaagcaggctctgaaaaaaagagtagttcaac

SEQ ID NO: 11113 - DNA, 50 bp, Artificial Sequence
  Amplification primer (forwards)
ggggacaagtttgtacaaaaaagcaggctctaatcaattatcagaaatca

SEQ ID NO: 11114 - DNA, 52 bp, Artificial Sequence
  Amplification primer (forwards)
ggggacaagtttgtacaaaaaagcaggctctcaagagtataaaacaaaagag

SEQ ID NO: 11115 - DNA, 49 bp, Artificial Sequence
  Amplification primer (forwards)
ggggacaagtttgtacaaaaaagcaggctctgctgtatttacactcgtc

SEQ ID NO: 11116 - DNA, 47 bp, Artificial Sequence
  Amplification primer (forwards)
ggggacaagtttgtacaaaaaagcaggctctggcggcaagataaaat

SEQ ID NO: 11117 - DNA, 50 bp, Artificial Sequence
  Amplification primer (forwards)
ggggacaagtttgtacaaaaaagcaggctctgatgggttaaagaataatg

SEQ ID NO: 11118 - DNA, 50 bp, Artificial Sequence
  Amplification primer (forwards)
ggggacaagtttgtacaaaaaagcaggctctgatgttgtaattagtggag

SEQ ID NO: 11119 - DNA, 46 bp, Artificial Sequence
  Amplification primer (forwards)
ggggacaagtttgtacaaaaaagcaggcttcgaattaagagaaaga

SEQ ID NO: 11120 - DNA, 49 bp, Artificial Sequence
  Amplification primer (forwards)
ggggacaagtttgtacaaaaaagcaggctctagctttttagtgatttca

SEQ ID NO: 11121 - DNA, 45 bp, Artificial Sequence
  Amplification primer (forwards)
ggggacaagtttgtacaaaaaagcaggctatacgcatagtggaac

SEQ ID NO: 11122 - DNA, 47 bp, Artificial Sequence
  Amplification primer (forwards)
ggggacaagtttgtacaaaaaagcaggctctgttattatcaggggcg

SEQ ID NO: 11123 - DNA, 47 bp, Artificial Sequence
  Amplification primer (forwards)
ggggacaagtttgtacaaaaaagcaggctctgttagtcgttctccga

SEQ ID NO: 11124 - DNA, 48 bp, Artificial Sequence
  Amplification primer (forwards)
ggggacaagtttgtacaaaaaagcaggctctgaggagcaagaattaaa

SEQ ID NO: 11125 - DNA, 49 bp, Artificial Sequence
  Amplification primer (forwards)
ggggacaagtttgtacaaaaaagcaggctctattctaacaaaagcaagt

SEQ ID NO: 11126 - DNA, 47 bp, Artificial Sequence
  Amplification primer (forwards)
ggggacaagtttgtacaaaaaagcaggctctagtgggcgttcatgga

SEQ ID NO: 11127 - DNA, 49 bp, Artificial Sequence
  Amplification primer (forwards)
ggggacaagtttgtacaaaaaagcaggctctgatacccctaatcaacta

SEQ ID NO: 11128 - DNA, 44 bp, Artificial Sequence
  Amplification primer (forwards)
ggggacaagtttgtacaaaaaagcaggctgcaggagctgtccgc

SEQ ID NO: 11129 - DNA, 47 bp, Artificial Sequence
  Amplification primer (forwards)
ggggacaagtttgtacaaaaaagcaggctctgtccgcattggtaaag

SEQ ID NO: 11130 - DNA, 49 bp, Artificial Sequence
  Amplification primer (forwards)
ggggacaagtttgtacaaaaaagcaggctctaactgcttagaaaatgaa

SEQ ID NO: 11131 - DNA, 44 bp, Artificial Sequence
  Amplification primer (forwards)
ggggacaagtttgtacaaaaaagcaggctctaacaactccagca

SEQ ID NO: 11132 - DNA, 47 bp, Artificial Sequence
  Amplification primer (forwards)
ggggacaagtttgtacaaaaaagcaggctctggaaaggtcagtgcag

SEQ ID NO: 11133 - DNA, 50 bp, Artificial Sequence
  Amplification primer (forwards)
ggggacaagtttgtacaaaaaagcaggctctattttattttcagatgaac

SEQ ID NO: 11134 - DNA, 47 bp, Artificial Sequence
  Amplification primer (forwards)
ggggacaagtttgtacaaaaaagcaggctctgcatcagatgttcaga

SEQ ID NO: 11135 - DNA, 48 bp, Artificial Sequence
  Amplification primer (forwards)
ggggacaagtttgtacaaaaaagcaggctctagtgacgttgacaaata

SEQ ID NO: 11136 - DNA, 50 bp, Artificial Sequence
  Amplification primer (forwards)
ggggacaagtttgtacaaaaaagcaggctctatgaccatttacttcaata

SEQ ID NO: 11137 - DNA, 47 bp, Artificial Sequence
  Amplification primer (forwards)
ggggacaagtttgtacaaaaaagcaggctctcaaactattttgacgc

SEQ ID NO: 11138 - DNA, 50 bp, Artificial Sequence
  Amplification primer (forwards)
ggggacaagtttgtacaaaaaagcaggctctgatgaatatctacgtgtcg

SEQ ID NO: 11139 - DNA, 50 bp, Artificial Sequence
  Amplification primer (forwards)
ggggacaagtttgtacaaaaaagcaggctctgatgaggtggactataaca

SEQ ID NO: 11140 - DNA, 50 bp, Artificial Sequence
  Amplification primer (forwards)
ggggacaagtttgtacaaaaaagcaggctctattttcttgctcttagttg

SEQ ID NO: 11141 - DNA, 50 bp, Artificial Sequence
  Amplification primer (forwards)
ggggacaagtttgtacaaaaaagcaggctctgaaactgtcattcaacttg

SEQ ID NO: 11142 - DNA, 48 bp, Artificial Sequence
  Amplification primer (forwards)
ggggacaagtttgtacaaaaaagcaggctattttttaacaacaaaaaa

SEQ ID NO: 11143 - DNA, 48 bp, Artificial Sequence
  Amplification primer (forwards)
ggggacaagtttgtacaaaaaagcaggctctccaatttttattggttt

SEQ ID NO: 11144 - DNA, 48 bp, Artificial Sequence; identical to SEQ ID NO: 10983
  Amplification primer (forwards)

SEQ ID NO: 11145 - DNA, 49 bp, Artificial Sequence
  Amplification primer (forwards)
ggggacaagtttgtacaaaaaagcaggctctacaatttatattgcttgg

SEQ ID NO: 11146 - DNA, 47 bp, Artificial Sequence
  Amplification primer (forwards)
ggggacaagtttgtacaaaaaagcaggctctgttggattgatgttgg

SEQ ID NO: 11147 - DNA, 44 bp, Artificial Sequence
  Amplification primer (forwards)
ggggacaagtttgtacaaaaaagcaggctggaaacaaatcacag

SEQ ID NO: 11148 - DNA, 51 bp, Artificial Sequence
  Amplification primer (forwards)
ggggacaagtttgtacaaaaaagcaggctctgcaatagtttttactttttt

SEQ ID NO: 11149 - DNA, 50 bp, Artificial Sequence
  Amplification primer (forwards)
ggggacaagtttgtacaaaaaagcaggctctggttcttatcatttaacaa

SEQ ID NO: 11150 - DNA, 47 bp, Artificial Sequence
  Amplification primer (forwards)
ggggacaagtttgtacaaaaaagcaggctctgctagacccaaacagt

SEQ ID NO: 11151 - DNA, 48 bp, Artificial Sequence
  Amplification primer (forwards)
ggggacaagtttgtacaaaaaagcaggctacactcatattgttgaaaa

SEQ ID NO: 11152 - DNA, 51 bp, Artificial Sequence
  Amplification primer (forwards)
ggggacaagtttgtacaaaaaagcaggctctaatagtactgagacaagtgc

SEQ ID NO: 11153 - DNA, 48 bp, Artificial Sequence
  Amplification primer (forwards)
ggggacaagtttgtacaaaaaagcaggctctgcttatgtcgtcaattt

SEQ ID NO: 11154 - DNA, 49 bp, Artificial Sequence
  Amplification primer (forwards)
ggggacaagtttgtacaaaaaagcaggctctgaattaccttcgtttatc

SEQ ID NO: 11155 - DNA, 50 bp, Artificial Sequence
  Amplification primer (forwards)
ggggacaagtttgtacaaaaaagcaggctctaaacatccgatacttaatg

SEQ ID NO: 11156 - DNA, 47 bp, Artificial Sequence
  Amplification primer (forwards)
ggggacaagtttgtacaaaaaagcaggctctaattatccttttgcga

SEQ ID NO: 11157 - DNA, 47 bp, Artificial Sequence
  Amplification primer (forwards)
ggggacaagtttgtacaaaaaagcaggctctggactacgcggagtat

SEQ ID NO: 11158 - DNA, 47 bp, Artificial Sequence
  Amplification primer (forwards)
ggggacaagtttgtacaaaaaagcaggctctgctattggagcagctg

SEQ ID NO: 11159 - DNA, 50 bp, Artificial Sequence
  Amplification primer (forwards)
ggggacaagtttgtacaaaaaagcaggctctgataaagaagggatagagg

SEQ ID NO: 11160 - DNA, 50 bp, Artificial Sequence
  Amplification primer (forwards)
ggggacaagtttgtacaaaaaagcaggctctaaagaaaaatcacaaactg

SEQ ID NO: 11161 - DNA, 52 bp, Artificial Sequence
  Amplification primer (forwards)
ggggacaagtttgtacaaaaaagcaggctctcaaaataataaaaaagtaaaa

SEQ ID NO: 11162 - DNA, 52 bp, Artificial Sequence; identical to SEQ ID NO: 11161
  Amplification primer (forwards)

SEQ ID NO: 11163 - DNA, 46 bp, Artificial Sequence
  Amplification primer (forwards)
ggggacaagtttgtacaaaaaagcaggctcaaatggtcaatctagc

SEQ ID NO: 11164 - DNA, 48 bp, Artificial Sequence
  Amplification primer (forwards)
ggggacaagtttgtacaaaaaagcaggctctaaggattcaaaaatccc

SEQ ID NO: 11165 - DNA, 47 bp, Artificial Sequence
  Amplification primer (forwards)
ggggacaagtttgtacaaaaaagcaggctctgggcaaccatctacat

SEQ ID NO: 11166 - DNA, 47 bp, Artificial Sequence
  Amplification primer (forwards)
ggggacaagtttgtacaaaaaagcaggctctcattcacaggatagca

SEQ ID NO: 11167 - DNA, 48 bp, Artificial Sequence
  Amplification primer (forwards)
ggggacaagtttgtacaaaaaagcaggctctggacgaggagaagtatc

SEQ ID NO: 11168 - DNA, 45 bp, Artificial Sequence
  Amplification primer (forwards)
ggggacaagtttgtacaaaaaagcaggctcacaatcttctcaaaa

SEQ ID NO: 11169 - DNA, 48 bp, Artificial Sequence
  Amplification primer (forwards)
ggggacaagtttgtacaaaaaagcaggctctgataagtcagcaaaccc

SEQ ID NO: 11170 - DNA, 49 bp, Artificial Sequence
  Amplification primer (forwards)
ggggacaagtttgtacaaaaaagcaggctctatcacgacattacagact

SEQ ID NO: 11171 - DNA, 49 bp, Artificial Sequence
  Amplification primer (forwards)
ggggacaagtttgtacaaaaaagcaggctctagatatttaactgctggt

SEQ ID NO: 11172 - DNA, 52 bp, Artificial Sequence
  Amplification primer (forwards)
ggggacaagtttgtacaaaaaagcaggctctataaaatatcaagatgatttt

SEQ ID NO: 11173 - DNA, 46 bp, Artificial Sequence
  Amplification primer (forwards)
ggggacaagtttgtacaaaaaagcaggcttagaagtcagagagcag

SEQ ID NO: 11174 - DNA, 47 bp, Artificial Sequence
  Amplification primer (forwards)
ggggacaagtttgtacaaaaaagcaggctctattatggagacgggta

SEQ ID NO: 11175 - DNA, 50 bp, Artificial Sequence
  Amplification primer (forwards)
ggggacaagtttgtacaaaaaagcaggctctttgaataataaaggtgtcg

SEQ ID NO: 11176 - DNA, 50 bp, Artificial Sequence; identical to SEQ ID NO: 11175
  Amplification primer (forwards)

SEQ ID NO: 11177 - DNA, 50 bp, Artificial Sequence
  Amplification primer (forwards)
ggggacaagtttgtacaaaaaagcaggctctatttcctcaaatttttacg

SEQ ID NO: 11178 - DNA, 49 bp, Artificial Sequence
  Amplification primer (forwards)
ggggacaagtttgtacaaaaaagcaggctctaatttttataagctcttg

SEQ ID NO: 11179 - DNA, 47 bp, Artificial Sequence
  Amplification primer (forwards)
ggggacaagtttgtacaaaaaagcaggctctgcgcttaaagaattaa

SEQ ID NO: 11180 - DNA, 47 bp, Artificial Sequence
  Amplification primer (forwards)
ggggacaagtttgtacaaaaaagcaggctttttaaaagaaattgaaa

SEQ ID NO: 11181 - DNA, 48 bp, Artificial Sequence
  Amplification primer (forwards)
ggggacaagtttgtacaaaaaagcaggctttcgtaaatataattttga

SEQ ID NO: 11182 - DNA, 49 bp, Artificial Sequence
  Amplification primer (forwards)
ggggacaagtttgtacaaaaaagcaggctctagcgatacctttaatttt

SEQ ID NO: 11183 - DNA, 47 bp, Artificial Sequence
  Amplification primer (forwards)
ggggacaagtttgtacaaaaaagcaggctctatgctgattaagtcgc

SEQ ID NO: 11184 - DNA, 45 bp, Artificial Sequence
  Amplification primer (forwards)
ggggacaagtttgtacaaaaaagcaggctgtggtaaaactggact

SEQ ID NO: 11185 - DNA, 48 bp, Artificial Sequence
  Amplification primer (forwards)
ggggacaagtttgtacaaaaaagcaggctctaagacaggagcacccgt

SEQ ID NO: 11186 - DNA, 44 bp, Artificial Sequence
  Amplification primer (forwards)
ggggacaagtttgtacaaaaaagcaggctgcgagtcaattgagc

SEQ ID NO: 11187 - DNA, 51 bp, Artificial Sequence
  Amplification primer (forwards)
ggggacaagtttgtacaaaaaagcaggctctacaaatactttgaaaaaaga

SEQ ID NO: 11188 - DNA, 50 bp, Artificial Sequence
  Amplification primer (forwards)
ggggacaagtttgtacaaaaaagcaggctctaatttatttaaacgttcct

SEQ ID NO: 11189 - DNA, 47 bp, Artificial Sequence
  Amplification primer (forwards)
ggggacaagtttgtacaaaaaagcaggctctaaaaagcggctagtca

SEQ ID NO: 11190 - DNA, 49 bp, Artificial Sequence
  Amplification primer (forwards)
ggggacaagtttgtacaaaaaagcaggctctggacaaaaatcaaaaata

SEQ ID NO: 11191 - DNA, 49 bp, Artificial Sequence; identical to SEQ ID NO: 11190
  Amplification primer (forwards)

SEQ ID NO: 11192 - DNA, 48 bp, Artificial Sequence
  Amplification primer (forwards)
ggggacaagtttgtacaaaaaagcaggctctggaggaaaatttcagaa

SEQ ID NO: 11193 - DNA, 50 bp, Artificial Sequence
  Amplification primer (forwards)
ggggacaagtttgtacaaaaaagcaggctctacctcatatccttttattt

SEQ ID NO: 11194 - DNA, 44 bp, Artificial Sequence
  Amplification primer (forwards)
ggggacaagtttgtacaaaaaagcaggctgtggacatcgtggtg

SEQ ID NO: 11195 - DNA, 50 bp, Artificial Sequence
  Amplification primer (forwards)
ggggacaagtttgtacaaaaaagcaggctctaagactaaaaaaatcatca

SEQ ID NO: 11196 - DNA, 49 bp, Artificial Sequence
  Amplification primer (forwards)
ggggacaagtttgtacaaaaaagcaggctctaaacacaccagtaaagaa

SEQ ID NO: 11197 - DNA, 52 bp, Artificial Sequence
  Amplification primer (forwards)
ggggacaagtttgtacaaaaaagcaggctctaaaaataaaaaaatcttattt

SEQ ID NO: 11198 - DNA, 49 bp, Artificial Sequence
  Amplification primer (forwards)
ggggacaagtttgtacaaaaaagcaggcttaataaaaggattattgtca

SEQ ID NO: 11199 - DNA, 48 bp, Artificial Sequence
  Amplification primer (forwards)
ggggacaagtttgtacaaaaaagcaggctctgctcgtttaataccaca

SEQ ID NO: 11200 - DNA, 49 bp, Artificial Sequence
  Amplification primer (forwards)
ggggacaagtttgtacaaaaaagcaggctctaacactaacatccctagc

SEQ ID NO: 11201 - DNA, 49 bp, Artificial Sequence
  Amplification primer (forwards)
ggggacaagtttgtacaaaaaagcaggctctagagggaaggttatttac

SEQ ID NO: 11202 - DNA, 51 bp, Artificial Sequence
  Amplification primer (forwards)
ggggacaagtttgtacaaaaaagcaggctctatcaataaagtaacagctca

SEQ ID NO: 11203 - DNA, 53 bp, Artificial Sequence
  Amplification primer (forwards)
ggggacaagtttgtacaaaaaagcaggctctagaacactatttagaatgatat

SEQ ID NO: 11204 - DNA, 45 bp, Artificial Sequence
  Amplification primer (forwards)
ggggacaagtttgtacaaaaaagcaggctactatgcgaatcacag

SEQ ID NO: 11205 - DNA, 48 bp, Artificial Sequence
  Amplification primer (forwards)
ggggacaagtttgtacaaaaaagcaggctctagtttagcattgcaaat

SEQ ID NO: 11206 - DNA, 50 bp, Artificial Sequence
  Amplification primer (forwards)
ggggacaagtttgtacaaaaaagcaggctctacattttataaaaagacgg

SEQ ID NO: 11207 - DNA, 51 bp, Artificial Sequence
  Amplification primer (forwards)
ggggacaagtttgtacaaaaaagcaggctctaagaaaatacgaagctatac

SEQ ID NO: 11208 - DNA, 49 bp, Artificial Sequence
  Amplification primer (forwards)
ggggacaagtttgtacaaaaaagcaggctctggaggaaatgaaatatta

SEQ ID NO: 11209 - DNA, 51 bp, Artificial Sequence
  Amplification primer (forwards)
ggggacaagtttgtacaaaaaagcaggctctggtatgtctaataaggaaat

SEQ ID NO: 11210 - DNA, 51 bp, Artificial Sequence
  Amplification primer (forwards)
ggggacaagtttgtacaaaaaagcaggctctaacaaacttattacagaaaa

SEQ ID NO: 11211 - DNA, 50 bp, Artificial Sequence
  Amplification primer (forwards)
ggggacaagtttgtacaaaaaagcaggctctgtttcatatgaaaaagtcc

SEQ ID NO: 11212 - DNA, 52 bp, Artificial Sequence
  Amplification primer (forwards)
ggggacaagtttgtacaaaaaagcaggctctagtagaggtatttttttacaa

SEQ ID NO: 11213 - DNA, 47 bp, Artificial Sequence
  Amplification primer (forwards)
ggggacaagtttgtacaaaaaagcaggctctgaacgtcgggtaagtc

SEQ ID NO: 11214 - DNA, 47 bp, Artificial Sequence
  Amplification primer (forwards)
ggggacaagtttgtacaaaaaagcaggctttttaatcgattttattt

SEQ ID NO: 11215 - DNA, 48 bp, Artificial Sequence
  Amplification primer (forwards)
ggggacaagtttgtacaaaaaagcaggctcattaattattcttacggt

SEQ ID NO: 11216 - DNA, 48 bp, Artificial Sequence
  Amplification primer (forwards)
ggggacaagtttgtacaaaaaagcaggctctttatacgttgttaaaca

SEQ ID NO: 11217 - DNA, 46 bp, Artificial Sequence
  Amplification primer (forwards)
ggggacaagtttgtacaaaaaagcaggctggctaagtaagcatgag

SEQ ID NO: 11218 - DNA, 44 bp, Artificial Sequence
  Amplification primer (forwards)
ggggacaagtttgtacaaaaaagcaggcttcccagctagctgtc

SEQ ID NO: 11219 - DNA, 52 bp, Artificial Sequence
  Amplification primer (forwards)
ggggacaagtttgtacaaaaaagcaggctctatagaaattgctgtattaatt

SEQ ID NO: 11220 - DNA, 50 bp, Artificial Sequence
  Amplification primer (forwards)
ggggacaagtttgtacaaaaaagcaggctctattcgatttcttattcttg

SEQ ID NO: 11221 - DNA, 48 bp, Artificial Sequence
  Amplification primer (forwards)
ggggacaagtttgtacaaaaaagcaggctctgactcaaccacagtctc

SEQ ID NO: 11222 - DNA, 48 bp, Artificial Sequence
  Amplification primer (forwards)
ggggacaagtttgtacaaaaaagcaggctctgcagaccttacaagtca

SEQ ID NO: 11223 - DNA, 49 bp, Artificial Sequence
  Amplification primer (forwards)
ggggacaagtttgtacaaaaaagcaggctctattgtatttgctattgca

SEQ ID NO: 11224 - DNA, 51 bp, Artificial Sequence
  Amplification primer (forwards)
ggggacaagtttgtacaaaaaagcaggctctgatattttttcagctattga

SEQ ID NO: 11225 - DNA, 49 bp, Artificial Sequence
  Amplification primer (forwards)
ggggacaagtttgtacaaaaaagcaggctctgttagtgctgctattgaa

SEQ ID NO: 11226 - DNA, 51 bp, Artificial Sequence
  Amplification primer (forwards)
ggggacaagtttgtacaaaaaagcaggctctaagaagcttacttttatttg

SEQ ID NO: 11227 - DNA, 46 bp, Artificial Sequence
  Amplification primer (forwards)
ggggacaagtttgtacaaaaaagcaggctcaaaaggatattcaaga

SEQ ID NO: 11228 - DNA, 54 bp, Artificial Sequence
  Amplification primer (forwards)
ggggacaagtttgtacaaaaaagcaggctctcataatatattaagatttttagg

SEQ ID NO: 11229 - DNA, 48 bp, Artificial Sequence
  Amplification primer (forwards)
ggggacaagtttgtacaaaaaagcaggctctattcttggtcaagatgt

SEQ ID NO: 11230 - DNA, 50 bp, Artificial Sequence
  Amplification primer (forwards)
ggggacaagtttgtacaaaaaagcaggctctcatgaaaatgttaaaaaag

SEQ ID NO: 11231 - DNA, 48 bp, Artificial Sequence
  Amplification primer (forwards)
ggggacaagtttgtacaaaaaagcaggctctaagtcaacggtaacaaa

SEQ ID NO: 11232 - DNA, 44 bp, Artificial Sequence
  Amplification primer (forwards)
ggggacaagtttgtacaaaaaagcaggcaggaaacgtttttcct

SEQ ID NO: 11233 - DNA, 49 bp, Artificial Sequence
  Amplification primer (forwards)
ggggacaagtttgtacaaaaaagcaggctctaaccataagggaaaagta

SEQ ID NO: 11234 - DNA, 49 bp, Artificial Sequence
  Amplification primer (forwards)
ggggacaagtttgtacaaaaaagcaggctctgctaaacaattaattggt

SEQ ID NO: 11235 - DNA, 49 bp, Artificial Sequence
  Amplification primer (forwards)
ggggacaagtttgtacaaaaaagcaggctctttgatggtgttgttattc

SEQ ID NO: 11236 - DNA, 50 bp, Artificial Sequence
  Amplification primer (forwards)
ggggacaagtttgtacaaaaaagcaggctctaaaacttatttgtcaaatg

SEQ ID NO: 11237 - DNA, 44 bp, Artificial Sequence
  Amplification primer (forwards)
ggggacaagtttgtacaaaaaagcaggctgggcttaccatactg

SEQ ID NO: 11238 - DNA, 47 bp, Artificial Sequence
  Amplification primer (forwards)
ggggacaagtttgtacaaaaaagcaggctctggccttaatcttaagc

SEQ ID NO: 11239 - DNA, 50 bp, Artificial Sequence
  Amplification primer (forwards)
ggggacaagtttgtacaaaaaagcaggctctcaatattttttgaaacaag

SEQ ID NO: 11240 - DNA, 48 bp, Artificial Sequence
  Amplification primer (forwards)
ggggacaagtttgtacaaaaaagcaggctttatttcaggttatatcaa

SEQ ID NO: 11241 - DNA, 48 bp, Artificial Sequence
  Amplification primer (forwards)
ggggacaagtttgtacaaaaaagcaggctctgaaaattggaagtttgc

SEQ ID NO: 11242 - DNA, 47 bp, Artificial Sequence
  Amplification primer (forwards)
ggggacaagtttgtacaaaaaagcaggctctattgaaaagggagttg

SEQ ID NO: 11243 - DNA, 50 bp, Artificial Sequence
  Amplification primer (forwards)
ggggacaagtttgtacaaaaaagcaggctctattgttggtagagaaatca

SEQ ID NO: 11244 - DNA, 48 bp, Artificial Sequence
  Amplification primer (forwards)
ggggacaagtttgtacaaaaaagcaggctatcatgtaaaaattgatca

SEQ ID NO: 11245 - DNA, 51 bp, Artificial Sequence
  Amplification primer (forwards)
ggggacaagtttgtacaaaaaagcaggctctgattttttatacaaaggagg

SEQ ID NO: 11246 - DNA, 52 bp, Artificial Sequence
  Amplification primer (forwards)
ggggacaagtttgtacaaaaaagcaggctctgaacgttatacagataaaatg

SEQ ID NO: 11247 - DNA, 49 bp, Artificial Sequence
  Amplification primer (forwards)
ggggacaagtttgtacaaaaaagcaggctctctttctcgtaaaaaagag

SEQ ID NO: 11248 - DNA, 52 bp, Artificial Sequence
  Amplification primer (forwards)
ggggacaagtttgtacaaaaaagcaggctctactcttgtcttagttgtttat

SEQ ID NO: 11249 - DNA, 50 bp, Artificial Sequence
  Amplification primer (forwards)
ggggacaagtttgtacaaaaaagcaggctctataaagaaagctgaaaatc

SEQ ID NO: 11250 - DNA, 51 bp, Artificial Sequence
  Amplification primer (forwards)
ggggacaagtttgtacaaaaaagcaggctctataaaaaatgctatagcata

SEQ ID NO: 11251 - DNA, 50 bp, Artificial Sequence
  Amplification primer (forwards)
ggggacaagtttgtacaaaaaagcaggctctcagccttctaaactacttc

SEQ ID NO: 11252 - DNA, 49 bp, Artificial Sequence
  Amplification primer (forwards)
ggggacaagtttgtacaaaaaagcaggctctgatttgtttagcatgttg

SEQ ID NO: 11253 - DNA, 47 bp, Artificial Sequence
  Amplification primer (forwards)
ggggacaagtttgtacaaaaaagcaggctctcttgcttccctgattt

SEQ ID NO: 11254 - DNA, 50 bp, Artificial Sequence
  Amplification primer (forwards)
ggggacaagtttgtacaaaaaagcaggctctcatcaatcaaatcattatc

SEQ ID NO: 11255 - DNA, 49 bp, Artificial Sequence
  Amplification primer (forwards)
ggggacaagtttgtacaaaaaagcaggctctatctttattatcggacaa

SEQ ID NO: 11256 - DNA, 52 bp, Artificial Sequence
  Amplification primer (forwards)
ggggacaagtttgtacaaaaaagcaggctctaaagaatttattaaagaatgg

SEQ ID NO: 11257 - DNA, 47 bp, Artificial Sequence
  Amplification primer (forwards)
ggggacaagtttgtacaaaaaagcaggctctgcagatgatggtggtt

SEQ ID NO: 11258 - DNA, 47 bp, Artificial Sequence
  Amplification primer (forwards)
ggggacaagtttgtacaaaaaagcaggcttaaatgatgcaataacaa

SEQ ID NO: 11259 - DNA, 44 bp, Artificial Sequence
  Amplification primer (forwards)
ggggacaagtttgtacaaaaaagcaggcttgctggattatcctc

SEQ ID NO: 11260 - DNA, 50 bp, Artificial Sequence
  Amplification primer (forwards)
ggggacaagtttgtacaaaaaagcaggctctgtatttatggcaaataaga

SEQ ID NO: 11261 - DNA, 49 bp, Artificial Sequence
  Amplification primer (forwards)
ggggacaagtttgtacaaaaaagcaggctctatgagttctctggaagtt

SEQ ID NO: 11262 - DNA, 47 bp, Artificial Sequence
  Amplification primer (forwards)
ggggacaagtttgtacaaaaaagcaggctctggtgtcctcaactctg

SEQ ID NO: 11263 - DNA, 48 bp, Artificial Sequence
  Amplification primer (forwards)
ggggacaagtttgtacaaaaaagcaggctctgttcatgattttggtga

SEQ ID NO: 11264 - DNA, 47 bp, Artificial Sequence
  Amplification primer (forwards)
ggggacaagtttgtacaaaaaagcaggctctggggtttggttttata

SEQ ID NO: 11265 - DNA, 49 bp, Artificial Sequence
  Amplification primer (forwards)
ggggacaagtttgtacaaaaaagcaggctctcaatcagacattaaagca

SEQ ID NO: 11266 - DNA, 47 bp, Artificial Sequence
  Amplification primer (forwards)
ggggacaagtttgtacaaaaaagcaggctctatttggaggggggaaa

SEQ ID NO: 11267 - DNA, 47 bp, Artificial Sequence
  Amplification primer (forwards)
ggggacaagtttgtacaaaaaagcaggctctaccaaatttgactggg

SEQ ID NO: 11268 - DNA, 47 bp, Artificial Sequence
  Amplification primer (forwards)
ggggacaagtttgtacaaaaaagcaggctctgttacgtttttcttat

SEQ ID NO: 11269 - DNA, 52 bp, Artificial Sequence
  Amplification primer (forwards)
ggggacaagtttgtacaaaaaagcaggctctaaaaagaaaagtttaattagc

SEQ ID NO: 11270 - DNA, 47 bp, Artificial Sequence
  Amplification primer (forwards)
ggggacaagtttgtacaaaaaagcaggctttgatttttttaagaaaa

SEQ ID NO: 11271 - DNA, 53 bp, Artificial Sequence
  Amplification primer (forwards)
ggggacaagtttgtacaaaaaagcaggctctaagaaattaattataggtattt

SEQ ID NO: 11272 - DNA, 47 bp, Artificial Sequence
  Amplification primer (forwards)
ggggacaagtttgtacaaaaaagcaggctctggtttttcgtttttga

SEQ ID NO: 11273 - DNA, 50 bp, Artificial Sequence
  Amplification primer (forwards)
ggggacaagtttgtacaaaaaagcaggctctctattctcagatgaaacaa

SEQ ID NO: 11274 - DNA, 52 bp, Artificial Sequence
  Amplification primer (forwards)
ggggacaagtttgtacaaaaaagcaggctctgttaaattaaaatcgttactg

SEQ ID NO: 11275 - DNA, 47 bp, Artificial Sequence
  Amplification primer (forwards)
ggggacaagtttgtacaaaaaagcaggctctatgcaacgattaggac

SEQ ID NO: 11276 - DNA, 45 bp, Artificial Sequence
  Amplification primer (forwards)
ggggacaagtttgtacaaaaaagcaggcttaggtgaaagcaaatc

SEQ ID NO: 11277 - DNA, 50 bp, Artificial Sequence
  Amplification primer (forwards)
ggggacaagtttgtacaaaaaagcaggctctggaggattttatatgaaag

SEQ ID NO: 11278 - DNA, 49 bp, Artificial Sequence
  Amplification primer (forwards)
ggggacaagtttgtacaaaaaagcaggctctgcacacacacctactagt

SEQ ID NO: 11279 - DNA, 47 bp, Artificial Sequence
  Amplification primer (forwards)
ggggacaagtttgtacaaaaaagcaggctctaacaatcgttcaaagc

SEQ ID NO: 11280 - DNA, 51 bp, Artificial Sequence
  Amplification primer (forwards)
ggggacaagtttgtacaaaaaagcaggctctaaaaagtttttaaaagtttt

SEQ ID NO: 11281 - DNA, 46 bp, Artificial Sequence
  Amplification primer (forwards)
ggggacaagtttgtacaaaaaagcaggctggaataatcatcagtca

SEQ ID NO: 11282 - DNA, 47 bp, Artificial Sequence
  Amplification primer (forwards)
ggggacaagtttgtacaaaaaagcaggctctcaatctaaagggcaaa

SEQ ID NO: 11283 - DNA, 47 bp, Artificial Sequence; identical to SEQ ID NO: 11282
  Amplification primer (forwards)

SEQ ID NO: 11284 - DNA, 50 bp, Artificial Sequence
  Amplification primer (forwards)
ggggacaagtttgtacaaaaaagcaggctattacttatcaaaagaaaagg

SEQ ID NO: 11285 - DNA, 51 bp, Artificial Sequence
  Amplification primer (forwards)
ggggacaagtttgtacaaaaaagcaggctctcaagtattaaatgacaatgg

SEQ ID NO: 11286 - DNA, 46 bp, Artificial Sequence
  Amplification primer (forwards)
ggggacaagtttgtacaaaaaagcaggcttgaatcgtaaaaaaagg

SEQ ID NO: 11287 - DNA, 47 bp, Artificial Sequence
  Amplification primer (forwards)
ggggacaagtttgtacaaaaaagcaggctctatgggtctagcaacaa

SEQ ID NO: 11288 - DNA, 47 bp, Artificial Sequence; identical to SEQ ID NO: 11287
  Amplification primer (forwards)

SEQ ID NO: 11289 - DNA, 48 bp, Artificial Sequence
  Amplification primer (forwards)
ggggacaagtttgtacaaaaaagcaggctctgttacagctaaacacgg

SEQ ID NO: 11290 - DNA, 49 bp, Artificial Sequence
  Amplification primer (forwards)
ggggacaagtttgtacaaaaaagcaggctctggtcattttagtgaaaaa

SEQ ID NO: 11291 - DNA, 48 bp, Artificial Sequence
  Amplification primer (forwards)
ggggacaagtttgtacaaaaaagcaggctctagcgacataaaaatcat

SEQ ID NO: 11292 - DNA, 49 bp, Artificial Sequence
  Amplification primer (forwards)
ggggacaagtttgtacaaaaaagcaggctctaaaggtattattttagcg

SEQ ID NO: 11293 - DNA, 48 bp, Artificial Sequence
  Amplification primer (forwards)
ggggacaagtttgtacaaaaaagcaggctctattcagattggcaaatt

SEQ ID NO: 11294 - DNA, 52 bp, Artificial Sequence
  Amplification primer (forwards)
ggggacaagtttgtacaaaaaagcaggctctactaaatttattgttgattca

SEQ ID NO: 11295 - DNA, 47 bp, Artificial Sequence
  Amplification primer (forwards)
ggggacaagtttgtacaaaaaagcaggctttgaaatacttaaacctg

SEQ ID NO: 11296 - DNA, 51 bp, Artificial Sequence
  Amplification primer (forwards)
ggggacaagtttgtacaaaaaagcaggctctgcttctacaaataatgtttc

SEQ ID NO: 11297 - DNA, 51 bp, Artificial Sequence
  Amplification primer (forwards)
ggggacaagtttgtacaaaaaagcaggctctgtaattaatattgagcaagc

SEQ ID NO: 11298 - DNA, 50 bp, Artificial Sequence
  Amplification primer (forwards)
ggggacaagtttgtacaaaaaagcaggctctgaaatcaacactgaaatag

SEQ ID NO: 11299 - DNA, 51 bp, Artificial Sequence
  Amplification primer (forwards)
ggggacaagtttgtacaaaaaagcaggctctacaaggcatataaaaatttc

SEQ ID NO: 11300 - DNA, 48 bp, Artificial Sequence
  Amplification primer (forwards)
ggggacaagtttgtacaaaaaagcaggctctaacgaaatcaaatgccc

SEQ ID NO: 11301 - DNA, 49 bp, Artificial Sequence
  Amplification primer (forwards)
ggggacaagtttgtacaaaaaagcaggctctggacgagtaatgaaaaca

SEQ ID NO: 11302 - DNA, 48 bp, Artificial Sequence
  Amplification primer (forwards)
ggggacaagtttgtacaaaaaagcaggctctgggaaaaaaattgtttt

SEQ ID NO: 11303 - DNA, 53 bp, Artificial Sequence
  Amplification primer (forwards)
ggggacaagtttgtacaaaaaagcaggctctaaatttacagaacttaacttat

SEQ ID NO: 11304 - DNA, 47 bp, Artificial Sequence
  Amplification primer (forwards)
ggggacaagtttgtacaaaaaagcaggcatgacacagatgaatttta

SEQ ID NO: 11305 - DNA, 44 bp, Artificial Sequence
  Amplification primer (forwards)
ggggacaagtttgtacaaaaaagcaggcttgcaacttggaattg

SEQ ID NO: 11306 - DNA, 49 bp, Artificial Sequence
  Amplification primer (forwards)
ggggacaagtttgtacaaaaaagcaggctctgctaaagagagggtagat

SEQ ID NO: 11307 - DNA, 49 bp, Artificial Sequence
  Amplification primer (forwards)
ggggacaagtttgtacaaaaaagcaggctcaattattactgatgtttac

SEQ ID NO: 11308 - DNA, 49 bp, Artificial Sequence
  Amplification primer (forwards)
ggggacaagtttgtacaaaaaagcaggctctactgcaactaaacaacat

SEQ ID NO: 11309 - DNA, 49 bp, Artificial Sequence
  Amplification primer (forwards)
ggggacaagtttgtacaaaaaagcaggctctaaacgtattgctgtttta

SEQ ID NO: 11310 - DNA, 52 bp, Artificial Sequence
  Amplification primer (forwards)
ggggacaagtttgtacaaaaaagcaggctctaaattttatcttgttagacac

SEQ ID NO: 11311 - DNA, 50 bp, Artificial Sequence
  Amplification primer (forwards)
ggggacaagtttgtacaaaaaagcaggctctataggggattattcagtaa

SEQ ID NO: 11312 - DNA, 48 bp, Artificial Sequence
  Amplification primer (forwards)
ggggacaagtttgtacaaaaaagcaggctctactgaacgaacattcga

SEQ ID NO: 11313 - DNA, 50 bp, Artificial Sequence
  Amplification primer (forwards)
ggggacaagtttgtacaaaaaagcaggctctaataagccatattcaatag

SEQ ID NO: 11314 - DNA, 50 bp, Artificial Sequence; identical to SEQ ID NO: 11313
  Amplification primer (forwards)

SEQ ID NO: 11315 - DNA, 48 bp, Artificial Sequence
  Amplification primer (forwards)
ggggacaagtttgtacaaaaaagcaggctctgacttgaatggcaatat

SEQ ID NO: 11316 - DNA, 53 bp, Artificial Sequence
  Amplification primer (forwards)
ggggacaagtttgtacaaaaaagcaggctctattgattttattatttctattg

SEQ ID NO: 11317 - DNA, 48 bp, Artificial Sequence
  Amplification primer (forwards)
ggggacaagtttgtacaaaaaagcaggcttaaaacattttggtagtaa

SEQ ID NO: 11318 - DNA, 50 bp, Artificial Sequence
  Amplification primer (forwards)
ggggacaagtttgtacaaaaaagcaggctctactatttatgaccaaattg

SEQ ID NO: 11319 - DNA, 51 bp, Artificial Sequence
  Amplification primer (forwards)
ggggacaagtttgtacaaaaaagcaggctctaaaaataaaaaagatcagtt

SEQ ID NO: 11320 - DNA, 49 bp, Artificial Sequence
  Amplification primer (forwards)
ggggacaagtttgtacaaaaaagcaggctctcaagaaacagatacgacg

SEQ ID NO: 11321 - DNA, 49 bp, Artificial Sequence
  Amplification primer (forwards)
ggggacaagtttgtacaaaaaagcaggctctggtaatgagtcaaagaac

SEQ ID NO: 11322 - DNA, 48 bp, Artificial Sequence
  Amplification primer (forwards)
ggggacaagtttgtacaaaaaagcaggctctggaagtaaatcagcttc

SEQ ID NO: 11323 - DNA, 47 bp, Artificial Sequence
  Amplification primer (forwards)
ggggacaagtttgtacaaaaaagcaggctctgcttggcaacttgttc

SEQ ID NO: 11324 - DNA, 48 bp, Artificial Sequence
  Amplification primer (forwards)
ggggacaagtttgtacaaaaaagcaggctctggcatctcagacttacc

SEQ ID NO: 11325 - DNA, 47 bp, Artificial Sequence
  Amplification primer (forwards)
ggggacaagtttgtacaaaaaagcaggctctaaattcaaatctgggg

SEQ ID NO: 11326 - DNA, 47 bp, Artificial Sequence; identical to SEQ ID NO: 11325
  Amplification primer (forwards)

SEQ ID NO: 11327 - DNA, 47 bp, Artificial Sequence
  Amplification primer (forwards)
ggggacaagtttgtacaaaaaagcaggctctggagggaaaatgaatc

SEQ ID NO: 11328 - DNA, 47 bp, Artificial Sequence; identical to SEQ ID NO: 11327
  Amplification primer (forwards)

SEQ ID NO: 11329 - DNA, 47 bp, Artificial Sequence
  Amplification primer (forwards)
ggggacaagtttgtacaaaaaagcaggctctggcaacttcaaagcat

SEQ ID NO: 11330 - DNA, 47 bp, Artificial Sequence
  Amplification primer (forwards)
ggggacaagtttgtacaaaaaagcaggctctgaccaagtcggtgtcc

SEQ ID NO: 11331 - DNA, 50 bp, Artificial Sequence
  Amplification primer (forwards)
ggggacaagtttgtacaaaaaagcaggctctaaatcaaagacctcttcta

SEQ ID NO: 11332 - DNA, 49 bp, Artificial Sequence
  Amplification primer (forwards)
ggggacaagtttgtacaaaaaagcaggctctaataaacgcgtaaaaatc

SEQ ID NO: 11333 - DNA, 48 bp, Artificial Sequence
  Amplification primer (forwards)
ggggacaagtttgtacaaaaaagcaggctctaccagaacagtagcaat

SEQ ID NO: 11334 - DNA, 50 bp, Artificial Sequence
  Amplification primer (forwards)
ggggacaagtttgtacaaaaaagcaggctctacaaaaaacctgttattaa

SEQ ID NO: 11335 - DNA, 52 bp, Artificial Sequence
  Amplification primer (forwards)
ggggacaagtttgtacaaaaaagcaggctctattgatatacaaaaaataaaa

SEQ ID NO: 11336 - DNA, 47 bp, Artificial Sequence
  Amplification primer (forwards)
ggggacaagtttgtacaaaaaagcaggctctggatcattgagggcaa

SEQ ID NO: 11337 - DNA, 53 bp, Artificial Sequence
  Amplification primer (forwards)
ggggacaagtttgtacaaaaaagcaggctctaatttagtaaaagtgaatagtg

SEQ ID NO: 11338 - DNA, 51 bp, Artificial Sequence
  Amplification primer (forwards)
ggggacaagtttgtacaaaaaagcaggctctgaagaagaaaaatattttga

SEQ ID NO: 11339 - DNA, 49 bp, Artificial Sequence
  Amplification primer (forwards)
ggggacaagtttgtacaaaaaagcaggctctcaggttgaagttgactta

SEQ ID NO: 11340 - DNA, 49 bp, Artificial Sequence
  Amplification primer (forwards)
ggggacaagtttgtacaaaaaagcaggctctgaaacagattcgtttgta

SEQ ID NO: 11341 - DNA, 49 bp, Artificial Sequence
  Amplification primer (forwards)
ggggacaagtttgtacaaaaaagcaggctctgctataatagacaaaaag

SEQ ID NO: 11342 - DNA, 45 bp, Artificial Sequence
  Amplification primer (forwards)
ggggacaagtttgtacaaaaaagcaggctcgaaaccgattaagat

SEQ ID NO: 11343 - DNA, 47 bp, Artificial Sequence
  Amplification primer (forwards)
ggggacaagtttgtacaaaaaagcaggctctcaagtcatgcgctatg

SEQ ID NO: 11344 - DNA, 52 bp, Artificial Sequence
  Amplification primer (forwards)
ggggacaagtttgtacaaaaaagcaggctctggatttctctataattacttc

SEQ ID NO: 11345 - DNA, 48 bp, Artificial Sequence
  Amplification primer (forwards)
ggggacaagtttgtacaaaaaagcaggctctggaaaaccattgttaac

SEQ ID NO: 11346 - DNA, 49 bp, Artificial Sequence
  Amplification primer (forwards)
ggggacaagtttgtacaaaaaagcaggctctcagaaaattgaaggtatt

SEQ ID NO: 11347 - DNA, 47 bp, Artificial Sequence
  Amplification primer (forwards)
ggggacaagtttgtacaaaaaagcaggctctgaaatgcaagttcaaa

SEQ ID NO: 11348 - DNA, 47 bp, Artificial Sequence
  Amplification primer (forwards)
ggggacaagtttgtacaaaaaagcaggctctgcacaacgcagaatgt

SEQ ID NO: 11349 - DNA, 47 bp, Artificial Sequence
  Amplification primer (forwards)
ggggacaagtttgtacaaaaaagcaggctctaaaaacctgaattggg

SEQ ID NO: 11350 - DNA, 53 bp, Artificial Sequence
  Amplification primer (forwards)
ggggacaagtttgtacaaaaaagcaggctctaataaaatagctaatacagaag

SEQ ID NO: 11351 - DNA, 52 bp, Artificial Sequence
  Amplification primer (forwards)
ggggacaagtttgtacaaaaaagcaggctctattgatattcattctcatatc

SEQ ID NO: 11352 - DNA, 51 bp, Artificial Sequence
  Amplification primer (forwards)
ggggacaagtttgtacaaaaaagcaggctctactggatctaaaaaattagc

SEQ ID NO: 11353 - DNA, 52 bp, Artificial Sequence
  Amplification primer (forwards)
ggggacaagtttgtacaaaaaagcaggctctaaagatcgcttatataataaa

SEQ ID NO: 11354 - DNA, 52 bp, Artificial Sequence
  Amplification primer (forwards)
ggggacaagtttgtacaaaaaagcaggctctgcaaaagatataattaaggtt

SEQ ID NO: 11355 - DNA, 45 bp, Artificial Sequence
  Amplification primer (forwards)
ggggacaagtttgtacaaaaaagcaggctcagaagatcaaaaaca

SEQ ID NO: 11356 - DNA, 51 bp, Artificial Sequence
  Amplification primer (forwards)
ggggacaagtttgtacaaaaaagcaggctctactttttttaaaaagctaaa

SEQ ID NO: 11357 - DNA, 51 bp, Artificial Sequence
  Amplification primer (forwards)
ggggacaagtttgtacaaaaaagcaggctctggtacagatagtaaatttgg

SEQ ID NO: 11358 - DNA, 50 bp, Artificial Sequence
  Amplification primer (forwards)
ggggacaagtttgtacaaaaaagcaggctctacaatgttaaaaattgaaa

SEQ ID NO: 11359 - DNA, 52 bp, Artificial Sequence
  Amplification primer (forwards)
ggggacaagtttgtacaaaaaagcaggctctattaaagaactaaaagaattt

SEQ ID NO: 11360 - DNA, 44 bp, Artificial Sequence
  Amplification primer (forwards)
ggggacaagtttgtacaaaaaagcaggctctcgctcactacctt

SEQ ID NO: 11361 - DNA, 53 bp, Artificial Sequence
  Amplification primer (forwards)
ggggacaagtttgtacaaaaaagcaggctctaaattctatattattgatgatg

SEQ ID NO: 11362 - DNA, 48 bp, Artificial Sequence
  Amplification primer (forwards)
ggggacaagtttgtacaaaaaagcaggcttggaacatttttatattat

SEQ ID NO: 11363 - DNA, 47 bp, Artificial Sequence
  Amplification primer (forwards)
ggggacaagtttgtacaaaaaagcaggcttttatacaattgaagagc

SEQ ID NO: 11364 - DNA, 46 bp, Artificial Sequence
  Amplification primer (forwards)
ggggacaagtttgtacaaaaaagcaggctcaagaaataattacggt

SEQ ID NO: 11365 - DNA, 47 bp, Artificial Sequence
  Amplification primer (forwards)
ggggacaagtttgtacaaaaaagcaggctctataatgaaggcggtct

SEQ ID NO: 11366 - DNA, 49 bp, Artificial Sequence
  Amplification primer (forwards)
ggggacaagtttgtacaaaaaagcaggctctagcgtatatgttagtgga

SEQ ID NO: 11367 - DNA, 47 bp, Artificial Sequence
  Amplification primer (forwards)
ggggacaagtttgtacaaaaaagcaggctctactaaaccacaggggg

SEQ ID NO: 11368 - DNA, 47 bp, Artificial Sequence; identical to SEQ ID NO: 11367
  Amplification primer (forwards)

SEQ ID NO: 11369 - DNA, 51 bp, Artificial Sequence
  Amplification primer (forwards)
ggggacaagtttgtacaaaaaagcaggctctggtaatgaaggaaatatcac

SEQ ID NO: 11370 - DNA, 50 bp, Artificial Sequence
  Amplification primer (forwards)
ggggacaagtttgtacaaaaaagcaggctctctcgaattaaaaaatattg

SEQ ID NO: 11371 - DNA, 49 bp, Artificial Sequence
  Amplification primer (forwards)
ggggacaagtttgtacaaaaaagcaggctctaactatatgggtatgggc

SEQ ID NO: 11372 - DNA, 52 bp, Artificial Sequence
  Amplification primer (forwards)
ggggacaagtttgtacaaaaaagcaggctctggaactgctacatatagtagg

SEQ ID NO: 11373 - DNA, 45 bp, Artificial Sequence
  Amplification primer (forwards)
ggggacaagtttgtacaaaaaagcaggctggcttgacattatttt

SEQ ID NO: 11374 - DNA, 51 bp, Artificial Sequence
  Amplification primer (forwards)
ggggacaagtttgtacaaaaaagcaggctctaagaaattaaaaatattccc

SEQ ID NO: 11375 - DNA, 49 bp, Artificial Sequence
  Amplification primer (forwards)
ggggacaagtttgtacaaaaaagcaggctctaaaatcattattcaacgt

SEQ ID NO: 11376 - DNA, 48 bp, Artificial Sequence
  Amplification primer (forwards)
ggggacaagtttgtacaaaaaagcaggctctagtagaatgattccagg

SEQ ID NO: 11377 - DNA, 47 bp, Artificial Sequence
  Amplification primer (forwards)
ggggacaagtttgtacaaaaaagcaggctctaccgaatttaatgacg

SEQ ID NO: 11378 - DNA, 53 bp, Artificial Sequence
  Amplification primer (forwards)
ggggacaagtttgtacaaaaaagcaggctctaaagatagatatattttagcag

SEQ ID NO: 11379 - DNA, 46 bp, Artificial Sequence
  Amplification primer (forwards)
ggggacaagtttgtacaaaaaagcaggctcagaaaaatattccact

SEQ ID NO: 11380 - DNA, 47 bp, Artificial Sequence
  Amplification primer (forwards)
ggggacaagtttgtacaaaaaagcaggctctgaaattggtcagcaaa

SEQ ID NO: 11381 - DNA, 53 bp, Artificial Sequence
  Amplification primer (forwards)
ggggacaagtttgtacaaaaaagcaggctctaagttcgaaaatataatatatg

SEQ ID NO: 11382 - DNA, 52 bp, Artificial Sequence
  Amplification primer (forwards)
ggggacaagtttgtacaaaaaagcaggctctgaaaaagaaactattttaagt

SEQ ID NO: 11383 - DNA, 50 bp, Artificial Sequence
  Amplification primer (forwards)
ggggacaagtttgtacaaaaaagcaggctctaaagaaaagaaaaatttgg

SEQ ID NO: 11384 - DNA, 51 bp, Artificial Sequence
  Amplification primer (forwards)
ggggacaagtttgtacaaaaaagcaggctctggtaataaactgatgtatca

SEQ ID NO: 11385 - DNA, 52 bp, Artificial Sequence
  Amplification primer (forwards)
ggggacaagtttgtacaaaaaagcaggctctgaagatcaactcactatattt

SEQ ID NO: 11386 - DNA, 47 bp, Artificial Sequence
  Amplification primer (forwards)
ggggacaagtttgtacaaaaaagcaggctctcaaattacccgagaag

SEQ ID NO: 11387 - DNA, 53 bp, Artificial Sequence
  Amplification primer (forwards)
ggggacaagtttgtacaaaaaagcaggctctcttaaaagattacttactgaag

SEQ ID NO: 11388 - DNA, 47 bp, Artificial Sequence
  Amplification primer (forwards)
ggggacaagtttgtacaaaaaagcaggctctcttgggatagctcaca

SEQ ID NO: 11389 - DNA, 54 bp, Artificial Sequence
  Amplification primer (forwards)
ggggacaagtttgtacaaaaaagcaggctctataaagtttaaattattttttaa

SEQ ID NO: 11390 - DNA, 53 bp, Artificial Sequence
  Amplification primer (forwards)
ggggacaagtttgtacaaaaaagcaggctctattttacagacgaatatactat

SEQ ID NO: 11391 - DNA, 48 bp, Artificial Sequence
  Amplification primer (forwards)
ggggacaagtttgtacaaaaaagcaggctctagaataattgttgtcgg

SEQ ID NO: 11392 - DNA, 46 bp, Artificial Sequence
  Amplification primer (forwards)
ggggacaagtttgtacaaaaaagcaggctctaatgtaaaaaaacgc

SEQ ID NO: 11393 - DNA, 51 bp, Artificial Sequence
  Amplification primer (forwards)
ggggacaagtttgtacaaaaaagcaggctctctagtatcaaaggagaaagc

SEQ ID NO: 11394 - DNA, 46 bp, Artificial Sequence
  Amplification primer (forwards)
ggggacaagtttgtacaaaaaagcaggctctggtatgttgttagca

SEQ ID NO: 11395 - DNA, 53 bp, Artificial Sequence
  Amplification primer (forwards)
ggggacaagtttgtacaaaaaagcaggctctcttatgataataaattcattcg

SEQ ID NO: 11396 - DNA, 52 bp, Artificial Sequence
  Amplification primer (forwards)
ggggacaagtttgtacaaaaaagcaggctctatgaatagtgaacataaaatt

SEQ ID NO: 11397 - DNA, 47 bp, Artificial Sequence
  Amplification primer (forwards)
ggggacaagtttgtacaaaaaagcaggctctagggaaacttactgga

SEQ ID NO: 11398 - DNA, 50 bp, Artificial Sequence
  Amplification primer (forwards)
ggggacaagtttgtacaaaaaagcaggctctaaaaaagtcatcgatttaa

SEQ ID NO: 11399 - DNA, 51 bp, Artificial Sequence
  Amplification primer (forwards)
ggggacaagtttgtacaaaaaagcaggctctattacatatgatttcacaag

SEQ ID NO: 11400 - DNA, 50 bp, Artificial Sequence
  Amplification primer (forwards)
ggggacaagtttgtacaaaaaagcaggctctaataaatcttggttgagaa

SEQ ID NO: 11401 - DNA, 48 bp, Artificial Sequence
  Amplification primer (forwards)
ggggacaagtttgtacaaaaaagcaggctctcctatgttgtctgttgg

SEQ ID NO: 11402 - DNA, 50 bp, Artificial Sequence
  Amplification primer (forwards)
ggggacaagtttgtacaaaaaagcaggctctacttatcaaaaaacagttg

SEQ ID NO: 11403 - DNA, 44 bp, Artificial Sequence
  Amplification primer (forwards)
ggggacaagtttgtacaaaaaagcaggctttgtcaaagggattt

SEQ ID NO: 11404 - DNA, 54 bp, Artificial Sequence
  Amplification primer (forwards)
ggggacaagtttgtacaaaaaagcaggctctaaattatttgataagtttataga

SEQ ID NO: 11405 - DNA, 48 bp, Artificial Sequence
  Amplification primer (forwards)
ggggacaagtttgtacaaaaaagcaggctctaaaactgctacagttag

SEQ ID NO: 11406 - DNA, 50 bp, Artificial Sequence
  Amplification primer (forwards)
ggggacaagtttgtacaaaaaagcaggctatttagaacaattaaaagagg

SEQ ID NO: 11407 - DNA, 52 bp, Artificial Sequence
  Amplification primer (forwards)
ggggacaagtttgtacaaaaaagcaggctctaaagttttagtagttgatgat

SEQ ID NO: 11408 - DNA, 47 bp, Artificial Sequence
  Amplification primer (forwards)
ggggacaagtttgtacaaaaaagcaggctctaaaatagttgaaggcg

SEQ ID NO: 11409 - DNA, 50 bp, Artificial Sequence
  Amplification primer (forwards)
ggggacaagtttgtacaaaaaagcaggctctggaattgaatttaaaaatg

SEQ ID NO: 11410 - DNA, 50 bp, Artificial Sequence
  Amplification primer (forwards)
ggggacaagtttgtacaaaaaagcaggctctggaaaatattttggtacag

SEQ ID NO: 11411 - DNA, 50 bp, Artificial Sequence
  Amplification primer (forwards)
ggggacaagtttgtacaaaaaagcaggctctgaggttagaatggtaactc

SEQ ID NO: 11412 - DNA, 51 bp, Artificial Sequence
  Amplification primer (forwards)
ggggacaagtttgtacaaaaaagcaggctctaaaatagatgacctaagaaa

SEQ ID NO: 11413 - DNA, 48 bp, Artificial Sequence
  Amplification primer (forwards)
ggggacaagtttgtacaaaaaagcaggcttgaaaattcagtattatca

SEQ ID NO: 11414 - DNA, 53 bp, Artificial Sequence
  Amplification primer (forwards)
ggggacaagtttgtacaaaaaagcaggctctgataaaaataatttagaagact

SEQ ID NO: 11415 - DNA, 48 bp, Artificial Sequence
  Amplification primer (forwards)
ggggacaagtttgtacaaaaaagcaggctctaaaattgacatgaggaa

SEQ ID NO: 11416 - DNA, 48 bp, Artificial Sequence; identical to SEQ ID NO: 11415
  Amplification primer (forwards)

SEQ ID NO: 11417 - DNA, 50 bp, Artificial Sequence
  Amplification primer (forwards)
ggggacaagtttgtacaaaaaagcaggctctaaccacttacttaacctca

SEQ ID NO: 11418 - DNA, 52 bp, Artificial Sequence
  Amplification primer (forwards)
ggggacaagtttgtacaaaaaagcaggctctaaggtagtagtagctattgat

SEQ ID NO: 11419 - DNA, 49 bp, Artificial Sequence
  Amplification primer (forwards)
ggggacaagtttgtacaaaaaagcaggctctactgaagagagaaatcct

SEQ ID NO: 11420 - DNA, 52 bp, Artificial Sequence
  Amplification primer (forwards)
ggggacaagtttgtacaaaaaagcaggctctgctttattatcagttattgtc

SEQ ID NO: 11421 - DNA, 54 bp, Artificial Sequence
  Amplification primer (forwards)
ggggacaagtttgtacaaaaaagcaggctctaaagactatattaacagaatatt

SEQ ID NO: 11422 - DNA, 47 bp, Artificial Sequence
  Amplification primer (forwards)
ggggacaagtttgtacaaaaaagcaggctctggattttttgcacagc

SEQ ID NO: 11423 - DNA, 48 bp, Artificial Sequence
  Amplification primer (forwards)
ggggacaagtttgtacaaaaaagcaggctctattgttggtgaacaaga

SEQ ID NO: 11424 - DNA, 47 bp, Artificial Sequence
  Amplification primer (forwards)
ggggacaagtttgtacaaaaaagcaggcttaaatcaatattttctgc

SEQ ID NO: 11425 - DNA, 47 bp, Artificial Sequence
  Amplification primer (forwards)
ggggacaagtttgtacaaaaaagcaggctctgagcgaattcctgttc

SEQ ID NO: 11426 - DNA, 48 bp, Artificial Sequence
  Amplification primer (forwards)
ggggacaagtttgtacaaaaaagcaggctctgaagtcattcgtgaaca

SEQ ID NO: 11427 - DNA, 49 bp, Artificial Sequence
  Amplification primer (forwards)
ggggacaagtttgtacaaaaaagcaggctcaaaacaatatgattatatc

SEQ ID NO: 11428 - DNA, 47 bp, Artificial Sequence
  Amplification primer (forwards)
ggggacaagtttgtacaaaaaagcaggctctagcaagcctaatgttg

SEQ ID NO: 11429 - DNA, 51 bp, Artificial Sequence
  Amplification primer (forwards)
ggggacaagtttgtacaaaaaagcaggctctgatttaaataattacatcgc

SEQ ID NO: 11430 - DNA, 50 bp, Artificial Sequence
  Amplification primer (forwards)
ggggacaagtttgtacaaaaaagcaggctctaaacgtgaattactactcg

SEQ ID NO: 11431 - DNA, 48 bp, Artificial Sequence
  Amplification primer (forwards)
ggggacaagtttgtacaaaaaagcaggctctatacgccagtttttaag

SEQ ID NO: 11432 - DNA, 44 bp, Artificial Sequence
  Amplification primer (forwards)
ggggacaagtttgtacaaaaaagcaggcttttcgagcgattttg

SEQ ID NO: 11433 - DNA, 49 bp, Artificial Sequence
  Amplification primer (forwards)
ggggacaagtttgtacaaaaaagcaggctctgtaaccaaagttgaagag

SEQ ID NO: 11434 - DNA, 51 bp, Artificial Sequence
  Amplification primer (forwards)
ggggacaagtttgtacaaaaaagcaggctctatgaaagattttattgaatg

SEQ ID NO: 11435 - DNA, 51 bp, Artificial Sequence; identical to SEQ ID NO: 11434
  Amplification primer (forwards)

SEQ ID NO: 11436 - DNA, 52 bp, Artificial Sequence
  Amplification primer (forwards)
ggggacaagtttgtacaaaaaagcaggctctatagcctttaatagtttattt

SEQ ID NO: 11437 - DNA, 54 bp, Artificial Sequence
  Amplification primer (forwards)
ggggacaagtttgtacaaaaaagcaggctctdacagtttataatataaaccatg

SEQ ID NO: 11438 - DNA, 48 bp, Artificial Sequence
  Amplification primer (forwards)
ggggacaagtttgtacaaaaaagcaggctattcttttgaagaactttt

SEQ ID NO: 11439 - DNA, 48 bp, Artificial Sequence
  Amplification primer (forwards)
ggggacaagtttgtacaaaaaagcaggctctataaaaattttgatccc

SEQ ID NO: 11440 - DNA, 48 bp, Artificial Sequence
  Amplification primer (forwards)
ggggacaagtttgtacaaaaaagcaggctctaatcattccattgaatc

SEQ ID NO: 11441 - DNA, 46 bp, Artificial Sequence
  Amplification primer (forwards)
ggggacaagtttgtacaaaaaagcaggcttacaaaaaaaatatcgg

SEQ ID NO: 11442 - DNA, 47 bp, Artificial Sequence
  Amplification primer (forwards)
ggggacaagtttgtacaaaaaagcaggctctgcggctcaattagctg

SEQ ID NO: 11443 - DNA, 47 bp, Artificial Sequence
  Amplification primer (forwards)
ggggacaagtttgtacaaaaaagcaggctctcgtaccttcaaaccag

SEQ ID NO: 11444 - DNA, 50 bp, Artificial Sequence
  Amplification primer (forwards)
ggggacaagtttgtacaaaaaagcaggctctattaaagcaacttttactc

SEQ ID NO: 11445 - DNA, 46 bp, Artificial Sequence
  Amplification primer (forwards)
ggggacaagtttgtacaaaaaagcaggctcaatttttcagacaaca

SEQ ID NO: 11446 - DNA, 51 bp, Artificial Sequence
  Amplification primer (forwards)
ggggacaagtttgtacaaaaaagcaggctctagaaaacgtaatgatacatt

SEQ ID NO: 11447 - DNA, 49 bp, Artificial Sequence
  Amplification primer (forwards)
ggggacaagtttgtacaaaaaagcaggctctgattgtcaaattacacca

SEQ ID NO: 11448 - DNA, 48 bp, Artificial Sequence
  Amplification primer (forwards)
ggggacaagtttgtacaaaaaagcaggctctatttttcgtggtgataa

SEQ ID NO: 11449 - DNA, 49 bp, Artificial Sequence
  Amplification primer (forwards)
ggggacaagtttgtacaaaaaagcaggcttttttaatattgaatatcac

SEQ ID NO: 11450 - DNA, 49 bp, Artificial Sequence
  Amplification primer (forwards)
ggggacaagtttgtacaaaaaagcaggctctaagggagtccaatatatg

SEQ ID NO: 11451 - DNA, 47 bp, Artificial Sequence
  Amplification primer (forwards)
ggggacaagtttgtacaaaaaagcaggctctcgtcgcatgaatacca

SEQ ID NO: 11452 - DNA, 47 bp, Artificial Sequence
  Amplification primer (forwards)
ggggacaagtttgtacaaaaaagcaggctctatagaattttcagggc

SEQ ID NO: 11453 - DNA, 50 bp, Artificial Sequence
  Amplification primer (forwards)
ggggacaagtttgtacaaaaaagcaggctctgctactcactctaactcag

SEQ ID NO: 11454 - DNA, 46 bp, Artificial Sequence
  Amplification primer (forwards)
ggggacaagtttgtacaaaaaagcaggctgctcttcttcaaatact

SEQ ID NO: 11455 - DNA, 50 bp, Artificial Sequence
  Amplification primer (forwards)
ggggacaagtttgtacaaaaaagcaggctctctaacaccatttacaaaag

SEQ ID NO: 11456 - DNA, 50 bp, Artificial Sequence
  Amplification primer (forwards)
ggggacaagtttgtacaaaaaagcaggctctcaacaaggtattatggata

SEQ ID NO: 11457 - DNA, 49 bp, Artificial Sequence
  Amplification primer (forwards)
ggggacaagtttgtacaaaaaagcaggctctaaaattttaggtacacca

SEQ ID NO: 11458 - DNA, 48 bp, Artificial Sequence
  Amplification primer (forwards)
ggggacaagtttgtacaaaaaagcaggctctggaaaaatggttaagaa

SEQ ID NO: 11459 - DNA, 48 bp, Artificial Sequence
  Amplification primer (forwards)
ggggacaagtttgtacaaaaaagcaggctctaaattcgtccgaaccgt

SEQ ID NO: 11460 - DNA, 47 bp, Artificial Sequence
  Amplification primer (forwards)
ggggacaagtttgtacaaaaaagcaggctctggtcttccaacgcagc

SEQ ID NO: 11461 - DNA, 44 bp, Artificial Sequence
  Amplification primer (forwards)
ggggacaagtttgtacaaaaaagcaggctgctcaggtaaaacat

SEQ ID NO: 11462 - DNA, 47 bp, Artificial Sequence
  Amplification primer (forwards)
ggggacaagtttgtacaaaaaagcaggctctgaaagcaaatctttgc

SEQ ID NO: 11463 - DNA, 44 bp, Artificial Sequence
  Amplification primer (forwards)
ggggacaagtttgtacaaaaaagcaggctgtgctaattggattg

SEQ ID NO: 11464 - DNA, 44 bp, Artificial Sequence
  Amplification primer (forwards)
ggggacaagtttgtacaaaaaagcaggctgtggaaatgtcggag

SEQ ID NO: 11465 - DNA, 44 bp, Artificial Sequence
  Amplification primer (forwards)
ggggacaagtttgtacaaaaaagcaggctgtcagtcaaaccaca

SEQ ID NO: 11466 - DNA, 50 bp, Artificial Sequence
  Amplification primer (forwards)
ggggacaagtttgtacaaaaaagcaggctctgctagtttttattttttcc

SEQ ID NO: 11467 - DNA, 45 bp, Artificial Sequence
  Amplification primer (forwards)
ggggacaagtttgtacaaaaaagcaggctgtggaagtaaatcagc

SEQ ID NO: 11468 - DNA, 52 bp, Artificial Sequence; identical to SEQ ID NO: 11274
  Amplification primer (forwards)

SEQ ID NO: 11469 - DNA, 47 bp, Artificial Sequence
  Amplification primer (forwards)
ggggacaagtttgtacaaaaaagcaggctctattgctggtcctagtg

SEQ ID NO: 11470 - DNA, 46 bp, Artificial Sequence
  Amplification primer (forwards)
ggggacaagtttgtacaaaaaagcaggcttattttttggaaattgg

SEQ ID NO: 11471 - DNA, 49 bp, Artificial Sequence; identical to SEQ ID NO: 11115
  Amplification primer (forwards)

SEQ ID NO: 11472 - DNA, 48 bp, Artificial Sequence
  Amplification primer (forwards)
ggggacaagtttgtacaaaaaagcaggcttttatatgaaagaacaaca

SEQ ID NO: 11473 - DNA, 47 bp, Artificial Sequence
  Amplification primer (forwards)
ggggacaagtttgtacaaaaaagcaggctcaattattattgggttaa

SEQ ID NO: 11474 - DNA, 50 bp, Artificial Sequence
  Amplification primer (forwards)
ggggacaagtttgtacaaaaaagcaggctctcctaaattaaccctagtct

SEQ ID NO: 11475 - DNA, 47 bp, Artificial Sequence
  Amplification primer (forwards)
ggggacaagtttgtacaaaaaagcaggctctagtcttgcgaaggcag

SEQ ID NO: 11476 - DNA, 51 bp, Artificial Sequence
  Amplification primer (forwards)
ggggacaagtttgtacaaaaaagcaggctctgtatttacactcgtcttaca

SEQ ID NO: 11477 - DNA, 50 bp, Artificial Sequence; identical to SEQ ID NO: 11277
  Amplification primer (forwards)

SEQ ID NO: 11478 - DNA, 52 bp, Artificial Sequence; identical to SEQ ID NO: 11274
  Amplification primer (forwards)

SEQ ID NO: 11479 - DNA, 48 bp, Artificial Sequence
  Amplification primer (forwards)
ggggacaagtttgtacaaaaaagcaggctctggttcatcagacaaaca

SEQ ID NO: 11480 - DNA, 53 bp, Artificial Sequence
  Amplification primer (forwards)
ggggacaagtttgtacaaaaaagcaggctctgtagttaaagttggtattaacg

SEQ ID NO: 11481 - DNA, 51 bp, Artificial Sequence
  Amplification primer (forwards)
ggggacaagtttgtacaaaaaagcaggctctgtattagaagtacatgctga

SEQ ID NO: 11482 - DNA, 48 bp, Artificial Sequence
  Amplification primer (forwards)
ggggacaagtttgtacaaaaaagcaggctctgagacaccagtaatggc

SEQ ID NO: 11483 - DNA, 47 bp, Artificial Sequence
  Amplification primer (forwards)
ggggacaagtttgtacaaaaaagcaggctctgctaacaagcaggatc

SEQ ID NO: 11484 - DNA, 52 bp, Artificial Sequence
  Amplification primer (forwards)
ggggacaagtttgtacaaaaaagcaggctctaataagtccagtaactctaag

SEQ ID NO: 11485 - DNA, 50 bp, Artificial Sequence
  Amplification primer (forwards)
ggggacaagtttgtacaaaaaagcaggctctgcttttgatgtaattatgc

SEQ ID NO: 11486 - DNA, 51 bp, Artificial Sequence
  Amplification primer (forwards)
ggggacaagtttgtacaaaaaagcaggctctattaactatgaggttaaagc

SEQ ID NO: 11487 - DNA, 52 bp, Artificial Sequence
  Amplification primer (forwards)
ggggacaagtttgtacaaaaaagcaggctctgtaattgttgaacttagtttg

SEQ ID NO: 11488 - DNA, 50 bp, Artificial Sequence
  Amplification primer (forwards)
ggggacaagtttgtacaaaaaagcaggctctcttaggaagtataagcaaa

SEQ ID NO: 11489 - DNA, 48 bp, Artificial Sequence
  Amplification primer (forwards)
ggggacaagtttgtacaaaaaagcaggctctaaaatttgtctggttgg

SEQ ID NO: 11490 - DNA, 52 bp, Artificial Sequence
  Amplification primer (forwards)
ggggacaagtttgtacaaaaaagcaggctctgacttttatgatatcaatctt

SEQ ID NO: 11491 - DNA, 47 bp, Artificial Sequence
  Amplification primer (forwards)
ggggacaagtttgtacaaaaaagcaggctatgctattatgcaaaaag

SEQ ID NO: 11492 - DNA, 47 bp, Artificial Sequence
  Amplification primer (forwards)
ggggacaagtttgtacaaaaaagcaggctctgcaatcgtttcagcag

SEQ ID NO: 11493 - DNA, 50 bp, Artificial Sequence
  Amplification primer (reverse)
ggggaccactttgtacaagaaagctgggttatttttagacatcatagaca

SEQ ID NO: 11494 - DNA, 45 bp, Artificial Sequence
  Amplification primer (reverse)
ggggaccactttgtacaagaaagctgggttgggaatgcctacaaa

SEQ ID NO: 11495 - DNA, 50 bp, Artificial Sequence
  Amplification primer (reverse)
ggggaccactttgtacaagaaagctgggttttttttactatactttttgt

SEQ ID NO: 11496 - DNA, 48 bp, Artificial Sequence
  Amplification primer (reverse)
ggggaccactttgtacaagaaagctgggttttcctttttaggcttact

SEQ ID NO: 11497 - DNA, 48 bp, Artificial Sequence
  Amplification primer (reverse)
ggggaccactttgtacaagaaagctgggttattagcttcatttgtcag

SEQ ID NO: 11498 - DNA, 50 bp, Artificial Sequence
  Amplification primer (reverse)
ggggaccactttgtacaagaaagctgggttagtttcttctttaaaatcat

SEQ ID NO: 11499 - DNA, 48 bp, Artificial Sequence
  Amplification primer (reverse)
ggggaccactttgtacaagaaagctgggttctctgaagctgtaaaacc

SEQ ID NO: 11500 - DNA, 49 bp, Artificial Sequence
  Amplification primer (reverse)
ggggaccactttgtacaagaaagctgggtttttatcaatgtttgaaacg

SEQ ID NO: 11501 - DNA, 50 bp, Artificial Sequence
  Amplification primer (reverse)
ggggaccactttgtacaagaaagctgggtttagtaaatcaagtttttgca

SEQ ID NO: 11502 - DNA, 47 bp, Artificial Sequence
  Amplification primer (reverse)
ggggaccactttgtacaagaaagctgggttatcccttctattttcga

SEQ ID NO: 11503 - DNA, 49 bp, Artificial Sequence
  Amplification primer (reverse)
ggggaccactttgtacaagaaagctgggttatgtagtgacgtttctgtg

SEQ ID NO: 11504 - DNA, 49 bp, Artificial Sequence; identical to SEQ ID NO: 11503
  Amplification primer (reverse)

SEQ ID NO: 11505 - DNA, 46 bp, Artificial Sequence
  Amplification primer (reverse)
ggggaccactttgtacaagaaagctgggttattgggtgtaagcatt

SEQ ID NO: 11506 - DNA, 47 bp, Artificial Sequence
  Amplification primer (reverse)
ggggaccactttgtacaagaaagctgggttcttaactctacccgtcc

SEQ ID NO: 11507 - DNA, 50 bp, Artificial Sequence
  Amplification primer (reverse)
ggggaccactttgtacaagaaagctgggttttttctcttattaaagaatt

SEQ ID NO: 11508 - DNA, 48 bp, Artificial Sequence
  Amplification primer (reverse)
ggggaccactttgtacaagaaagctgggttataccagccgttactatt

SEQ ID NO: 11509 - DNA, 49 bp, Artificial Sequence
  Amplification primer (reverse)
ggggaccactttgtacaagaaagctgggtttttagctgcttttttaatg

SEQ ID NO: 11510 - DNA, 50 bp, Artificial Sequence
  Amplification primer (reverse)
ggggaccactttgtacaagaaagctgggttaaatactacatttacaggtg

SEQ ID NO: 11511 - DNA, 49 bp, Artificial Sequence
  Amplification primer (reverse)
ggggaccactttgtacaagaaagctgggttttggttattctcctttaat

SEQ ID NO: 11512 - DNA, 50 bp, Artificial Sequence
  Amplification primer (reverse)
ggggaccactttgtacaagaaagctgggttattatatttttggatatttc

SEQ ID NO: 11513 - DNA, 47 bp, Artificial Sequence
  Amplification primer (reverse)
ggggaccactttgtacaagaaagctgggttgggctttttcttaaaaa

SEQ ID NO: 11514 - DNA, 45 bp, Artificial Sequence
  Amplification primer (reverse)
ggggaccactttgtacaagaaagctgggttgttggcatccctttt

SEQ ID NO: 11515 - DNA, 46 bp, Artificial Sequence
  Amplification primer (reverse)
ggggaccactttgtacaagaaagctgggttcttttgatgggattgg

SEQ ID NO: 11516 - DNA, 47 bp, Artificial Sequence
  Amplification primer (reverse)
ggggaccactttgtacaagaaagctgggttttgatttaacgatttga

SEQ ID NO: 11517 - DNA, 51 bp, Artificial Sequence
  Amplification primer (reverse)
ggggaccactttgtacaagaaagctgggtttttatctcctctaaaataatg

SEQ ID NO: 11518 - DNA, 48 bp, Artificial Sequence
  Amplification primer (reverse)
ggggaccactttgtacaagaaagctgggttctttgataagtcagacca

SEQ ID NO: 11519 - DNA, 46 bp, Artificial Sequence
  Amplification primer (reverse)
ggggaccactttgtacaagaaagctgggttgtaaccccaagctgat

SEQ ID NO: 11520 - DNA, 47 bp, Artificial Sequence
  Amplification primer (reverse)
ggggaccactttgtacaagaaagctgggtttgattttgcaatatcaa

SEQ ID NO: 11521 - DNA, 51 bp, Artificial Sequence
  Amplification primer (reverse)
ggggaccactttgtacaagaaagctgggtttttttgtaatttaagtactaa

SEQ ID NO: 11522 - DNA, 50 bp, Artificial Sequence
  Amplification primer (reverse)
ggggaccactttgtacaagaaagctgggttttcttttatattaagagctt

SEQ ID NO: 11523 - DNA, 47 bp, Artificial Sequence
  Amplification primer (reverse)
ggggaccactttgtacaagaaagctgggttattcggataaatgtagc

SEQ ID NO: 11524 - DNA, 47 bp, Artificial Sequence
  Amplification primer (reverse)
ggggaccactttgtacaagaaagctgggtttccatttttatcctcac

SEQ ID NO: 11525 - DNA, 47 bp, Artificial Sequence; identical to SEQ ID NO: 11524
  Amplification primer (reverse)

SEQ ID NO: 11526 - DNA, 47 bp, Artificial Sequence
  Amplification primer (reverse)
ggggaccactttgtacaagaaagctgggttatgacctctactttcca

SEQ ID NO: 11527 - DNA, 47 bp, Artificial Sequence
  Amplification primer (reverse)
ggggaccactttgtacaagaaagctgggttcttgtaatcacttggac

SEQ ID NO: 11528 - DNA, 48 bp, Artificial Sequence
  Amplification primer (reverse)
ggggaccactttgtacaagaaagctgggttattaatcatggtattggt

SEQ ID NO: 11529 - DNA, 46 bp, Artificial Sequence
  Amplification primer (reverse)
ggggaccactttgtacaagaaagctgggttccattgtggaatatca

SEQ ID NO: 11530 - DNA, 47 bp, Artificial Sequence
  Amplification primer (reverse)
ggggaccactttgtacaagaaagctgggtttttgtaaagcagttctt

SEQ ID NO: 11531 - DNA, 51 bp, Artificial Sequence
  Amplification primer (reverse)
ggggaccactttgtacaagaaagctgggttatcattcatatgatctctaga

SEQ ID NO: 11532 - DNA, 49 bp, Artificial Sequence
  Amplification primer (reverse)
ggggaccactttgtacaagaaagctgggttattttgattgattctactc

SEQ ID NO: 11533 - DNA, 48 bp, Artificial Sequence
  Amplification primer (reverse)
ggggaccactttgtacaagaaagctgggttttttgtttttttcaaata

SEQ ID NO: 11534 - DNA, 46 bp, Artificial Sequence
  Amplification primer (reverse)
ggggaccactttgtacaagaaagctgggttatcttcaacgtcctcc

SEQ ID NO: 11535 - DNA, 47 bp, Artificial Sequence
  Amplification primer (reverse)
ggggaccactttgtacaagaaagctgggttaaagtcaaaggaaactt

SEQ ID NO: 11536 - DNA, 52 bp, Artificial Sequence
  Amplification primer (reverse)
ggggaccactttgtacaagaaagctgggttttctttatctaatttataatag

SEQ ID NO: 11537 - DNA, 46 bp, Artificial Sequence
  Amplification primer (reverse)
ggggaccactttgtacaagaaagctgggttttgcaatgttttttct

SEQ ID NO: 11538 - DNA, 49 bp, Artificial Sequence
  Amplification primer (reverse)
ggggaccactttgtacaagaaagctgggtttaaactttggataatctgt

SEQ ID NO: 11539 - DNA, 48 bp, Artificial Sequence
  Amplification primer (reverse)
ggggaccactttgtacaagaaagctgggttgttgaaattttgatatga

SEQ ID NO: 11540 - DNA, 52 bp, Artificial Sequence
  Amplification primer (reverse)
ggggaccactttgtacaagaaagctgggttctcctttactatatagctaact

SEQ ID NO: 11541 - DNA, 48 bp, Artificial Sequence
  Amplification primer (reverse)
ggggaccactttgtacaagaaagctgggttttgtttgtgaagtaaaac

SEQ ID NO: 11542 - DNA, 50 bp, Artificial Sequence
  Amplification primer (reverse)
ggggaccactttgtacaagaaagctgggtttgataatatctccatatttt

SEQ ID NO: 11543 - DNA, 44 bp, Artificial Sequence
  Amplification primer (reverse)
ggggaccactttgtacaagaaagctgggttgcattggcgccata

SEQ ID NO: 11544 - DNA, 49 bp, Artificial Sequence
  Amplification primer (reverse)
ggggaccactttgtacaagaaagctgggttttctacacgacttttattc

SEQ ID NO: 11545 - DNA, 46 bp, Artificial Sequence
  Amplification primer (reverse)
ggggaccactttgtacaagaaagctgggttaagacctcctcgagat

SEQ ID NO: 11546 - DNA, 48 bp, Artificial Sequence
  Amplification primer (reverse)
ggggaccactttgtacaagaaagctgggtttgttttttctttctgttg

SEQ ID NO: 11547 - DNA, 47 bp, Artificial Sequence
  Amplification primer (reverse)
ggggaccactttgtacaagaaagctgggtttggattagtttgacctg

SEQ ID NO: 11548 - DNA, 49 bp, Artificial Sequence
  Amplification primer (reverse)
ggggaccactttgtacaagaaagctgggtttttatcgtaagcacttagg

SEQ ID NO: 11549 - DNA, 46 bp, Artificial Sequence
  Amplification primer (reverse)
ggggaccactttgtacaagaaagctgggttctccttccaggcatcg

SEQ ID NO: 11550 - DNA, 52 bp, Artificial Sequence
  Amplification primer (reverse)
ggggaccactttgtacaagaaagctgggttgtaaaagtatcttaaatagtca

SEQ ID NO: 11551 - DNA, 45 bp, Artificial Sequence
  Amplification primer (reverse)
ggggaccactttgtacaagaaagctgggtttgccattcctcctct

SEQ ID NO: 11552 - DNA, 49 bp, Artificial Sequence
  Amplification primer (reverse)
ggggaccactttgtacaagaaagctgggtttgttacctttttattttct

SEQ ID NO: 11553 - DNA, 46 bp, Artificial Sequence
  Amplification primer (reverse)
ggggaccactttgtacaagaaagctgggtttttttcatgcgattga

SEQ ID NO: 11554 - DNA, 49 bp, Artificial Sequence
  Amplification primer (reverse)
ggggaccactttgtacaagaaagctgggttgagacgtttcttatacctt

SEQ ID NO: 11555 - DNA, 49 bp, Artificial Sequence
  Amplification primer (reverse)
ggggaccactttgtacaagaaagctgggtttgtaccatatgttctctct

SEQ ID NO: 11556 - DNA, 48 bp, Artificial Sequence
  Amplification primer (reverse)
ggggaccactttgtacaagaaagctgggttaaaagttggactactttc

SEQ ID NO: 11557 - DNA, 43 bp, Artificial Sequence
  Amplification primer (reverse)
ggggaccactttgtacaagaaagctgggtttcgttttccaccc

SEQ ID NO: 11558 - DNA, 43 bp, Artificial Sequence; identical to SEQ ID NO: 11557
  Amplification primer (reverse)

SEQ ID NO: 11559 - DNA, 50 bp, Artificial Sequence
  Amplification primer (reverse)
ggggaccactttgtacaagaaagctgggttatttgggtaaatatagtaaa

SEQ ID NO: 11560 - DNA, 48 bp, Artificial Sequence
  Amplification primer (reverse)
ggggaccactttgtacaagaaagctgggtttttacgactaacctcaac

SEQ ID NO: 11561 - DNA, 45 bp, Artificial Sequence
  Amplification primer (reverse)
ggggaccactttgtacaagaaagctgggttaattccttttggtgg

SEQ ID NO: 11562 - DNA, 46 bp, Artificial Sequence
  Amplification primer (reverse)
ggggaccactttgtacaagaaagctgggttggcagaatacaccttc

SEQ ID NO: 11563 - DNA, 46 bp, Artificial Sequence
  Amplification primer (reverse)
ggggaccactttgtacaagaaagctgggttggctgacgtcgacgca

SEQ ID NO: 11564 - DNA, 52 bp, Artificial Sequence
  Amplification primer (reverse)
ggggaccactttgtacaagaaagctgggttaactctcttaatatattcttct

SEQ ID NO: 11565 - DNA, 49 bp, Artificial Sequence
  Amplification primer (reverse)
ggggaccactttgtacaagaaagctgggttgtctttttcaatattctgt

SEQ ID NO: 11566 - DNA, 49 bp, Artificial Sequence; identical to SEQ ID NO: 11565
  Amplification primer (reverse)

SEQ ID NO: 11567 - DNA, 49 bp, Artificial Sequence
  Amplification primer (reverse)
ggggaccactttgtacaagaaagctgggttcttctccttaggagtaacg

SEQ ID NO: 11568 - DNA, 53 bp, Artificial Sequence
  Amplification primer (reverse)
ggggaccactttgtacaagaaagctgggttattattatcaattaataactctt

SEQ ID NO: 11569 - DNA, 48 bp, Artificial Sequence
  Amplification primer (reverse)
ggggaccactttgtacaagaaagctgggttgtcaaacatacttccaaa

SEQ ID NO: 11570 - DNA, 46 bp, Artificial Sequence
  Amplification primer (reverse)
ggggaccactttgtacaagaaagctgggtttttcgtcgtataagca

SEQ ID NO: 11571 - DNA, 46 bp, Artificial Sequence; identical to SEQ ID NO: 11570
  Amplification primer (reverse)

SEQ ID NO: 11572 - DNA, 47 bp, Artificial Sequence
  Amplification primer (reverse)
ggggaccactttgtacaagaaagctgggtttgtcctcattttttcag

SEQ ID NO: 11573 - DNA, 47 bp, Artificial Sequence
  Amplification primer (reverse)
ggggaccactttgtacaagaaagctgggttaatacttgctggaacag

SEQ ID NO: 11574 - DNA, 48 bp, Artificial Sequence
  Amplification primer (reverse)
ggggaccactttgtacaagaaagctgggttgtctttcttcaattttgg

SEQ ID NO: 11575 - DNA, 48 bp, Artificial Sequence
  Amplification primer (reverse)
ggggaccactttgtacaagaaagctgggttgtcgtgatttttatgagt

SEQ ID NO: 11576 - DNA, 46 bp, Artificial Sequence
  Amplification primer (reverse)
ggggaccactttgtacaagaaagctgggttcccaaactggcataac

SEQ ID NO: 11577 - DNA, 46 bp, Artificial Sequence; identical to SEQ ID NO: 11576
  Amplification primer (reverse)

SEQ ID NO: 11578 - DNA, 46 bp, Artificial Sequence
  Amplification primer (reverse)
ggggaccactttgtacaagaaagctgggtttgaaggacgtttgttg

SEQ ID NO: 11579 - DNA, 49 bp, Artificial Sequence
  Amplification primer (reverse)
ggggaccactttgtacaagaaagctgggtttttttttagtttaaggcta

SEQ ID NO: 11580 - DNA, 44 bp, Artificial Sequence
  Amplification primer (reverse)
ggggaccactttgtacaagaaagctgggttgtccaccttccgat

SEQ ID NO: 11581 - DNA, 48 bp, Artificial Sequence
  Amplification primer (reverse)
ggggaccactttgtacaagaaagctgggttaacattgtttttcctttc

SEQ ID NO: 11582 - DNA, 46 bp, Artificial Sequence
  Amplification primer (reverse)
ggggaccactttgtacaagaaagctgggttatggtgatgatgacct

SEQ ID NO: 11583 - DNA, 47 bp, Artificial Sequence
  Amplification primer (reverse)
ggggaccactttgtacaagaaagctgggttattaacattttgagggt

SEQ ID NO: 11584 - DNA, 46 bp, Artificial Sequence
  Amplification primer (reverse)
ggggaccactttgtacaagaaagctgggttttttgcaaaatcaaca

SEQ ID NO: 11585 - DNA, 51 bp, Artificial Sequence
  Amplification primer (reverse)
ggggaccactttgtacaagaaagctgggttgaataaataactgtatttttt

SEQ ID NO: 11586 - DNA, 49 bp, Artificial Sequence
  Amplification primer (reverse)
ggggaccactttgtacaagaaagctgggttattttcattaatttcctct

SEQ ID NO: 11587 - DNA, 48 bp, Artificial Sequence
  Amplification primer (reverse)
ggggaccactttgtacaagaaagctgggttgatagctaattggtctgt

SEQ ID NO: 11588 - DNA, 48 bp, Artificial Sequence
  Amplification primer (reverse)
ggggaccactttgtacaagaaagctgggtttaaaagatgagcttctcg

SEQ ID NO: 11589 - DNA, 48 bp, Artificial Sequence
  Amplification primer (reverse)
ggggaccactttgtacaagaaagctgggttaatttcaatatagcgacg

SEQ ID NO: 11590 - DNA, 48 bp, Artificial Sequence
  Amplification primer (reverse)
ggggaccactttgtacaagaaagctgggttcttgtttgtctttacctt

SEQ ID NO: 11591 - DNA, 47 bp, Artificial Sequence
  Amplification primer (reverse)
ggggaccactttgtacaagaaagctgggttattatccttcaaagctg

SEQ ID NO: 11592 - DNA, 50 bp, Artificial Sequence
  Amplification primer (reverse)
ggggaccactttgtacaagaaagctgggtttgtgtcatataatgtaacca

SEQ ID NO: 11593 - DNA, 47 bp, Artificial Sequence
  Amplification primer (reverse)
ggggaccactttgtacaagaaagctgggtttgatcttaattttcgag

SEQ ID NO: 11594 - DNA, 46 bp, Artificial Sequence
  Amplification primer (reverse)
ggggaccactttgtacaagaaagctgggttccaaacaggttgatct

SEQ ID NO: 11595 - DNA, 49 bp, Artificial Sequence
  Amplification primer (reverse)
ggggaccactttgtacaagaaagctgggttatttacatcagactgtgac

SEQ ID NO: 11596 - DNA, 46 bp, Artificial Sequence
  Amplification primer (reverse)
ggggaccactttgtacaagaaagctgggtttttatggccaataaca

SEQ ID NO: 11597 - DNA, 50 bp, Artificial Sequence
  Amplification primer (reverse)
ggggaccactttgtacaagaaagctgggttttttttagtagttgtcaatt

SEQ ID NO: 11598 - DNA, 47 bp, Artificial Sequence
  Amplification primer (reverse)
ggggaccactttgtacaagaaagctgggttgtaagctgaattttcga

SEQ ID NO: 11599 - DNA, 47 bp, Artificial Sequence
  Amplification primer (reverse)
ggggaccactttgtacaagaaagctgggttacgagagtggttattgg

SEQ ID NO: 11600 - DNA, 50 bp, Artificial Sequence
  Amplification primer (reverse)
ggggaccactttgtacaagaaagctgggtttttcttcactctttctagag

SEQ ID NO: 11601 - DNA, 46 bp, Artificial Sequence
  Amplification primer (reverse)
ggggaccactttgtacaagaaagctgggttcggccagttttttctt

SEQ ID NO: 11602 - DNA, 46 bp, Artificial Sequence
  Amplification primer (reverse)
ggggaccactttgtacaagaaagctgggttaacacctggtgggcgt

SEQ ID NO: 11603 - DNA, 49 bp, Artificial Sequence
  Amplification primer (reverse)
ggggaccactttgtacaagaaagctgggttactatttctaattgctctg

SEQ ID NO: 11604 - DNA, 46 bp, Artificial Sequence
  Amplification primer (reverse)
ggggaccactttgtacaagaaagctgggtttggtcccggtgcgcca

SEQ ID NO: 11605 - DNA, 49 bp, Artificial Sequence; identical to SEQ ID NO: 11603
  Amplification primer (reverse)

SEQ ID NO: 11606 - DNA, 47 bp, Artificial Sequence
  Amplification primer (reverse)
ggggaccactttgtacaagaaagctgggttcttagcagattcatccc

SEQ ID NO: 11607 - DNA, 49 bp, Artificial Sequence
  Amplification primer (reverse)
ggggaccactttgtacaagaaagctgggtttttactatttgaaaattgg

SEQ ID NO: 11608 - DNA, 49 bp, Artificial Sequence
  Amplification primer (reverse)
ggggaccactttgtacaagaaagctgggtttttcataggaacttgtatt

SEQ ID NO: 11609 - DNA, 46 bp, Artificial Sequence
  Amplification primer (reverse)
ggggaccactttgtacaagaaagctgggttgtccacacctgcgact

SEQ ID NO: 11610 - DNA, 46 bp, Artificial Sequence; identical to SEQ ID NO: 11609
  Amplification primer (reverse)

SEQ ID NO: 11611 - DNA, 51 bp, Artificial Sequence
  Amplification primer (reverse)
ggggaccactttgtacaagaaagctgggtttttacctaagtaatattctga

SEQ ID NO: 11612 - DNA, 46 bp, Artificial Sequence
  Amplification primer (reverse)
ggggaccactttgtacaagaaagctgggtttccccgtcttttttgt

SEQ ID NO: 11613 - DNA, 48 bp, Artificial Sequence
  Amplification primer (reverse)
ggggaccactttgtacaagaaagctgggttgtcgtaatcataaaagcc

SEQ ID NO: 11614 - DNA, 48 bp, Artificial Sequence
  Amplification primer (reverse)
ggggaccactttgtacaagaaagctgggttttcataacgaaccataac

SEQ ID NO: 11615 - DNA, 47 bp, Artificial Sequence
  Amplification primer (reverse)
ggggaccactttgtacaagaaagctgggtttttgagttctagcaacg

SEQ ID NO: 11616 - DNA, 49 bp, Artificial Sequence
  Amplification primer (reverse)
ggggaccactttgtacaagaaagctgggttttttttatcttcttcttgc

SEQ ID NO: 11617 - DNA, 48 bp, Artificial Sequence
  Amplification primer (reverse)
ggggaccactttgtacaagaaagctgggttttttaaaacctggtaaac

SEQ ID NO: 11618 - DNA, 46 bp, Artificial Sequence
  Amplification primer (reverse)
ggggaccactttgtacaagaaagctgggtttcagctcgtactgttt

SEQ ID NO: 11619 - DNA, 46 bp, Artificial Sequence
  Amplification primer (reverse)
ggggaccactttgtacaagaaagctgggttgtcctcctcaattggt

SEQ ID NO: 11620 - DNA, 47 bp, Artificial Sequence
  Amplification primer (reverse)
ggggaccactttgtacaagaaagctgggttctcttttatacgcgatg

SEQ ID NO: 11621 - DNA, 47 bp, Artificial Sequence
  Amplification primer (reverse)
ggggaccactttgtacaagaaagctgggttgttatttgctcgttgtt

SEQ ID NO: 11622 - DNA, 48 bp, Artificial Sequence
  Amplification primer (reverse)
ggggaccactttgtacaagaaagctgggtttttctcaaatgttttcat

SEQ ID NO: 11623 - DNA, 48 bp, Artificial Sequence
  Amplification primer (reverse)
ggggaccactttgtacaagaaagctgggtttttcaaatgatctacagc

SEQ ID NO: 11624 - DNA, 46 bp, Artificial Sequence
  Amplification primer (reverse)
ggggaccactttgtacaagaaagctgggttggctagtgtctgtccg

SEQ ID NO: 11625 - DNA, 48 bp, Artificial Sequence
  Amplification primer (reverse)
ggggaccactttgtacaagaaagctgggttaccatctatttttacccc

SEQ ID NO: 11626 - DNA, 46 bp, Artificial Sequence
  Amplification primer (reverse)
ggggaccactttgtacaagaaagctgggttagaacccgcactctca

SEQ ID NO: 11627 - DNA, 46 bp, Artificial Sequence
  Amplification primer (reverse)
ggggaccactttgtacaagaaagctgggttgaacgcaacggctgct

SEQ ID NO: 11628 - DNA, 50 bp, Artificial Sequence
  Amplification primer (reverse)
ggggaccactttgtacaagaaagctgggtttttcatatcaaaaactatcg

SEQ ID NO: 11629 - DNA, 50 bp, Artificial Sequence
  Amplification primer (reverse)
ggggaccactttgtacaagaaagctgggttttctttatctcttaatgctt

SEQ ID NO: 11630 - DNA, 49 bp, Artificial Sequence
  Amplification primer (reverse)
ggggaccactttgtacaagaaagctgggttcacaacagttattttttca

SEQ ID NO: 11631 - DNA, 46 bp, Artificial Sequence
  Amplification primer (reverse)
ggggaccactttgtacaagaaagctgggttaggcccttctgagtag

SEQ ID NO: 11632 - DNA, 46 bp, Artificial Sequence; identical to SEQ ID NO: 11631
  Amplification primer (reverse)

SEQ ID NO: 11633 - DNA, 47 bp, Artificial Sequence
  Amplification primer (reverse)
ggggaccactttgtacaagaaagctgggttaaataatccaatggctg

SEQ ID NO: 11634 - DNA, 47 bp, Artificial Sequence
  Amplification primer (reverse)
ggggaccactttgtacaagaaagctgggttcttttcaagctttttcc

SEQ ID NO: 11635 - DNA, 48 bp, Artificial Sequence
  Amplification primer (reverse)
ggggaccactttgtacaagaaagctgggttaaaatgatcagtttgagg

SEQ ID NO: 11636 - DNA, 47 bp, Artificial Sequence
  Amplification primer (reverse)
ggggaccactttgtacaagaaagctgggtttttttggcttaagaaag

SEQ ID NO: 11637 - DNA, 51 bp, Artificial Sequence
  Amplification primer (reverse)
ggggaccactttgtacaagaaagctgggttcttacgatacattttaaattg

SEQ ID NO: 11638 - DNA, 49 bp, Artificial Sequence
  Amplification primer (reverse)
ggggaccactttgtacaagaaagctgggttttctttttttactttagcg

SEQ ID NO: 11639 - DNA, 46 bp, Artificial Sequence
  Amplification primer (reverse)
ggggaccactttgtacaagaaagctgggttccattgcaatccagca

SEQ ID NO: 11640 - DNA, 46 bp, Artificial Sequence
  Amplification primer (reverse)
ggggaccactttgtacaagaaagctgggttatgtttatggcttgct

SEQ ID NO: 11641 - DNA, 46 bp, Artificial Sequence
  Amplification primer (reverse)
ggggaccactttgtacaagaaagctgggtttttttgataaatcccc

SEQ ID NO: 11642 - DNA, 49 bp, Artificial Sequence
  Amplification primer (reverse)
ggggaccactttgtacaagaaagctgggttatatgtgtattcatccttt

SEQ ID NO: 11643 - DNA, 50 bp, Artificial Sequence
  Amplification primer (reverse)
ggggaccactttgtacaagaaagctgggtttacttctatttttccatctg

SEQ ID NO: 11644 - DNA, 49 bp, Artificial Sequence
  Amplification primer (reverse)
ggggaccactttgtacaagaaagctgggttgtaatgcaataaatcaaaa

SEQ ID NO: 11645 - DNA, 46 bp, Artificial Sequence
  Amplification primer (reverse)
ggggaccactttgtacaagaaagctgggttggattttagtttcgca

SEQ ID NO: 11646 - DNA, 46 bp, Artificial Sequence
  Amplification primer (reverse)
ggggaccactttgtacaagaaagctgggttcccattgatttcgtcg

SEQ ID NO: 11647 - DNA, 48 bp, Artificial Sequence
  Amplification primer (reverse)
ggggaccactttgtacaagaaagctgggtttacctctttcaataccac

SEQ ID NO: 11648 - DNA, 49 bp, Artificial Sequence
  Amplification primer (reverse)
ggggaccactttgtacaagaaagctgggttattaccgttaggtactgta

SEQ ID NO: 11649 - DNA, 48 bp, Artificial Sequence
  Amplification primer (reverse)
ggggaccactttgtacaagaaagctgggttggtatggttaacagaatc

SEQ ID NO: 11650 - DNA, 50 bp, Artificial Sequence
  Amplification primer (reverse)
ggggaccactttgtacaagaaagctgggttatataccctagactttttga

SEQ ID NO: 11651 - DNA, 50 bp, Artificial Sequence
  Amplification primer (reverse)
ggggaccactttgtacaagaaagctgggttaggagttttattgatgatat

SEQ ID NO: 11652 - DNA, 47 bp, Artificial Sequence
  Amplification primer (reverse)
ggggaccactttgtacaagaaagctgggttaaatgattgtggaaaaa

SEQ ID NO: 11653 - DNA, 49 bp, Artificial Sequence
  Amplification primer (reverse)
ggggaccactttgtacaagaaagctgggttatcaaagaagttgacattg

SEQ ID NO: 11654 - DNA, 49 bp, Artificial Sequence; identical to SEQ ID NO: 11653
  Amplification primer (reverse)

SEQ ID NO: 11655 - DNA, 50 bp, Artificial Sequence
  Amplification primer (reverse)
ggggaccactttgtacaagaaagctgggttgttagataaattaaccagtg

SEQ ID NO: 11656 - DNA, 46 bp, Artificial Sequence
  Amplification primer (reverse)
ggggaccactttgtacaagaaagctgggttccctttgcttcgttgt

SEQ ID NO: 11657 - DNA, 46 bp, Artificial Sequence
  Amplification primer (reverse)
ggggaccactttgtacaagaaagctgggttttccacaagtccgatt

SEQ ID NO: 11658 - DNA, 46 bp, Artificial Sequence
  Amplification primer (reverse)
ggggaccactttgtacaagaaagctgggttttgtttgattcgtcct

SEQ ID NO: 11659 - DNA, 46 bp, Artificial Sequence
  Amplification primer (reverse)
ggggaccactttgtacaagaaagctgggttactaccaaactgctgg

SEQ ID NO: 11660 - DNA, 50 bp, Artificial Sequence
  Amplification primer (reverse)
ggggaccactttgtacaagaaagctgggttttgtgtatttttagttaggt

SEQ ID NO: 11661 - DNA, 47 bp, Artificial Sequence
  Amplification primer (reverse)
ggggaccactttgtacaagaaagctgggttgtggataaaattcgaaa

SEQ ID NO: 11662 - DNA, 47 bp, Artificial Sequence
  Amplification primer (reverse)
ggggaccactttgtacaagaaagctgggttcagactgactaggagct

SEQ ID NO: 11663 - DNA, 48 bp, Artificial Sequence
  Amplification primer (reverse)
ggggaccactttgtacaagaaagctgggttgacttgtaattgattcgc

SEQ ID NO: 11664 - DNA, 46 bp, Artificial Sequence
  Amplification primer (reverse)
ggggaccactttgtacaagaaagctgggttgaaggcaccaccacct

SEQ ID NO: 11665 - DNA, 52 bp, Artificial Sequence
  Amplification primer (reverse)
ggggaccactttgtacaagaaagctgggttgttgtatagatgagttaatctg

SEQ ID NO: 11666 - DNA, 47 bp, Artificial Sequence
  Amplification primer (reverse)
ggggaccactttgtacaagaaagctgggttacggtttttaaagaatg

SEQ ID NO: 11667 - DNA, 49 bp, Artificial Sequence
  Amplification primer (reverse)
ggggaccactttgtacaagaaagctgggtttttttctttatcttctgtg

SEQ ID NO: 11668 - DNA, 47 bp, Artificial Sequence
  Amplification primer (reverse)
ggggaccactttgtacaagaaagctgggttcgattttgtaagagctt

SEQ ID NO: 11669 - DNA, 46 bp, Artificial Sequence
  Amplification primer (reverse)
ggggaccactttgtacaagaaagctgggttcgacgaagctatttct

SEQ ID NO: 11670 - DNA, 46 bp, Artificial Sequence
  Amplification primer (reverse)
ggggaccactttgtacaagaaagctgggtttaaggcttgcattttg

SEQ ID NO: 11671 - DNA, 48 bp, Artificial Sequence
  Amplification primer (reverse)
ggggaccactttgtacaagaaagctgggttttttcctaaaaattttcc

SEQ ID NO: 11672 - DNA, 46 bp, Artificial Sequence
  Amplification primer (reverse)
ggggaccactttgtacaagaaagctgggttggcatctcctagcttt

SEQ ID NO: 11673 - DNA, 50 bp, Artificial Sequence
  Amplification primer (reverse)
ggggaccactttgtacaagaaagctgggtttgataaaggtagttctacac

SEQ ID NO: 11674 - DNA, 50 bp, Artificial Sequence; identical to SEQ ID NO: 11673
  Amplification primer (reverse)

SEQ ID NO: 11675 - DNA, 48 bp, Artificial Sequence
  Amplification primer (reverse)
ggggaccactttgtacaagaaagctgggttttttagatgtttttgtgg

SEQ ID NO: 11676 - DNA, 49 bp, Artificial Sequence
  Amplification primer (reverse)
ggggaccactttgtacaagaaagctgggttatgattgataattttaagc

SEQ ID NO: 11677 - DNA, 46 bp, Artificial Sequence
  Amplification primer (reverse)
ggggaccactttgtacaagaaagctgggtttgctttttgatatgcc

SEQ ID NO: 11678 - DNA, 50 bp, Artificial Sequence
  Amplification primer (reverse)
ggggaccactttgtacaagaaagctgggtttaaaataaagttcagaaaag

SEQ ID NO: 11679 - DNA, 47 bp, Artificial Sequence
  Amplification primer (reverse)
ggggaccactttgtacaagaaagctgggtttttctcccttgactttc

SEQ ID NO: 11680 - DNA, 47 bp, Artificial Sequence
  Amplification primer (reverse)
ggggaccactttgtacaagaaagctgggttctttttctcagatgctt

SEQ ID NO: 11681 - DNA, 46 bp, Artificial Sequence
  Amplification primer (reverse)
ggggaccactttgtacaagaaagctgggttgacattgaaacggaat

SEQ ID NO: 11682 - DNA, 48 bp, Artificial Sequence
  Amplification primer (reverse)
ggggaccactttgtacaagaaagctgggttttttatcaatgatgttga

SEQ ID NO: 11683 - DNA, 46 bp, Artificial Sequence
  Amplification primer (reverse)
ggggaccactttgtacaagaaagctgggttcatatgacgcaaacgc

SEQ ID NO: 11684 - DNA, 46 bp, Artificial Sequence
  Amplification primer (reverse)
ggggaccactttgtacaagaaagctgggttagcctcttttcttgtt

SEQ ID NO: 11685 - DNA, 48 bp, Artificial Sequence
  Amplification primer (reverse)
ggggaccactttgtacaagaaagctgggttacgattatcaacaaagtt

SEQ ID NO: 11686 - DNA, 50 bp, Artificial Sequence
  Amplification primer (reverse)
ggggaccactttgtacaagaaagctgggttcattcttttaaatacaaatc

SEQ ID NO: 11687 - DNA, 46 bp, Artificial Sequence
  Amplification primer (reverse)
ggggaccactttgtacaagaaagctgggttgggtttgaaagttttc

SEQ ID NO: 11688 - DNA, 51 bp, Artificial Sequence
  Amplification primer (reverse)
ggggaccactttgtacaagaaagctgggtttttaactttaattactggaat

SEQ ID NO: 11689 - DNA, 48 bp, Artificial Sequence
  Amplification primer (reverse)
ggggaccactttgtacaagaaagctgggttttttttaataagcttcga

SEQ ID NO: 11690 - DNA, 48 bp, Artificial Sequence
  Amplification primer (reverse)
ggggaccactttgtacaagaaagctgggttttttttgtaaacttcctg

SEQ ID NO: 11691 - DNA, 51 bp, Artificial Sequence
  Amplification primer (reverse)
ggggaccactttgtacaagaaagctgggttcttagatacattgtttttttc

SEQ ID NO: 11692 - DNA, 48 bp, Artificial Sequence
  Amplification primer (reverse)
ggggaccactttgtacaagaaagctgggttctttcttttcttacttgc

SEQ ID NO: 11693 - DNA, 52 bp, Artificial Sequence
  Amplification primer (reverse)
ggggaccactttgtacaagaaagctgggtttttattatttttaatacttgaa

SEQ ID NO: 11694 - DNA, 49 bp, Artificial Sequence
  Amplification primer (reverse)
ggggaccactttgtacaagaaagctgggttcttcaactgttgatagagc

SEQ ID NO: 11695 - DNA, 46 bp, Artificial Sequence
  Amplification primer (reverse)
ggggaccactttgtacaagaaagctgggtttcctttagcaggagct

SEQ ID NO: 11696 - DNA, 50 bp, Artificial Sequence
  Amplification primer (reverse)
ggggaccactttgtacaagaaagctgggttgttatacatgttgtctgaag

SEQ ID NO: 11697 - DNA, 48 bp, Artificial Sequence
  Amplification primer (reverse)
ggggaccactttgtacaagaaagctgggttccaaataataacacgttt

SEQ ID NO: 11698 - DNA, 46 bp, Artificial Sequence
  Amplification primer (reverse)
ggggaccactttgtacaagaaagctgggttgctatccctttccaat

SEQ ID NO: 11699 - DNA, 50 bp, Artificial Sequence
  Amplification primer (reverse)
ggggaccactttgtacaagaaagctgggtttgtatttttaatttgttttc

SEQ ID NO: 11700 - DNA, 50 bp, Artificial Sequence; identical to SEQ ID NO: 11699
  Amplification primer (reverse)

SEQ ID NO: 11701 - DNA, 50 bp, Artificial Sequence
  Amplification primer (reverse)
ggggaccactttgtacaagaaagctgggttcaaacttttaacatttaatg

SEQ ID NO: 11702 - DNA, 48 bp, Artificial Sequence
  Amplification primer (reverse)
ggggaccactttgtacaagaaagctgggttatagtgtaagctaccagc

SEQ ID NO: 11703 - DNA, 48 bp, Artificial Sequence
  Amplification primer (reverse)
ggggaccactttgtacaagaaagctgggttgtcatcatattcctgaaa

SEQ ID NO: 11704 - DNA, 46 bp, Artificial Sequence
  Amplification primer (reverse)
ggggaccactttgtacaagaaagctgggtttgttcggcgtaagatt

SEQ ID NO: 11705 - DNA, 47 bp, Artificial Sequence
  Amplification primer (reverse)
ggggaccactttgtacaagaaagctgggttattggtcatttcttgag

SEQ ID NO: 11706 - DNA, 48 bp, Artificial Sequence
  Amplification primer (reverse)
ggggaccactttgtacaagaaagctgggttaacagatttattggttgg

SEQ ID NO: 11707 - DNA, 49 bp, Artificial Sequence
  Amplification primer (reverse)
ggggaccactttgtacaagaaagctgggttagactcatcaactttttct

SEQ ID NO: 11708 - DNA, 46 bp, Artificial Sequence
  Amplification primer (reverse)
ggggaccactttgtacaagaaagctgggttgaaccctgaagggtag

SEQ ID NO: 11709 - DNA, 48 bp, Artificial Sequence
  Amplification primer (reverse)
ggggaccactttgtacaagaaagctgggttccaattgtatttttcaac

SEQ ID NO: 11710 - DNA, 51 bp, Artificial Sequence
  Amplification primer (reverse)
ggggaccactttgtacaagaaagctgggttatttatactacctgttgaatc

SEQ ID NO: 11711 - DNA, 52 bp, Artificial Sequence
  Amplification primer (reverse)
ggggaccactttgtacaagaaagctgggtttttaaatttgtagtctttaata

SEQ ID NO: 11712 - DNA, 49 bp, Artificial Sequence
  Amplification primer (reverse)
ggggaccactttgtacaagaaagctgggttctcttttacttttccaaaa

SEQ ID NO: 11713 - DNA, 46 bp, Artificial Sequence
  Amplification primer (reverse)
ggggaccactttgtacaagaaagctgggttccctcccttaagagaa

SEQ ID NO: 11714 - DNA, 46 bp, Artificial Sequence
  Amplification primer (reverse)
ggggaccactttgtacaagaaagctgggttttgacgatgttgcatc

SEQ ID NO: 11715 - DNA, 48 bp, Artificial Sequence
  Amplification primer (reverse)
ggggaccactttgtacaagaaagctgggtttttcgaattattgtgact

SEQ ID NO: 11716 - DNA, 46 bp, Artificial Sequence
  Amplification primer (reverse)
ggggaccactttgtacaagaaagctgggttgtattgttgttgcctg

SEQ ID NO: 11717 - DNA, 47 bp, Artificial Sequence
  Amplification primer (reverse)
ggggaccactttgtacaagaaagctgggtttttttgatttccctttc

SEQ ID NO: 11718 - DNA, 48 bp, Artificial Sequence
  Amplification primer (reverse)
ggggaccactttgtacaagaaagctgggtttttatagtgtgtttgcaa

SEQ ID NO: 11719 - DNA, 47 bp, Artificial Sequence
  Amplification primer (reverse)
ggggaccactttgtacaagaaagctgggtttttgctaggaactttga

SEQ ID NO: 11720 - DNA, 47 bp, Artificial Sequence
  Amplification primer (reverse)
ggggaccactttgtacaagaaagctgggtttgattcaattccttttc

SEQ ID NO: 11721 - DNA, 49 bp, Artificial Sequence
  Amplification primer (reverse)
ggggaccactttgtacaagaaagctgggtttttttcctctactttctta

SEQ ID NO: 11722 - DNA, 46 bp, Artificial Sequence
  Amplification primer (reverse)
ggggaccactttgtacaagaaagctgggtttttgctcacctccaca

SEQ ID NO: 11723 - DNA, 51 bp, Artificial Sequence
  Amplification primer (reverse)
ggggaccactttgtacaagaaagctgggttcaataacttctgtaaaataaa

SEQ ID NO: 11724 - DNA, 48 bp, Artificial Sequence
  Amplification primer (reverse)
ggggaccactttgtacaagaaagctgggttttcacccttaaaataatt

SEQ ID NO: 11725 - DNA, 46 bp, Artificial Sequence
  Amplification primer (reverse)
ggggaccactttgtacaagaaagctgggtttgcatttttcccttct

SEQ ID NO: 11726 - DNA, 52 bp, Artificial Sequence
  Amplification primer (reverse)
ggggaccactttgtacaagaaagctgggttctccagtaaagtattagtattt

SEQ ID NO: 11727 - DNA, 47 bp, Artificial Sequence
  Amplification primer (reverse)
ggggaccactttgtacaagaaagctgggttgtgaggttttggtaatt

SEQ ID NO: 11728 - DNA, 49 bp, Artificial Sequence
  Amplification primer (reverse)
ggggaccactttgtacaagaaagctgggtttgcatataagttttttagc

SEQ ID NO: 11729 - DNA, 49 bp, Artificial Sequence; identical to SEQ ID NO: 11728
  Amplification primer (reverse)

SEQ ID NO: 11730 - DNA, 49 bp, Artificial Sequence
  Amplification primer (reverse)
ggggaccactttgtacaagaaagctgggttctcatctaaagtgctatcc

SEQ ID NO: 11731 - DNA, 47 bp, Artificial Sequence
  Amplification primer (reverse)
ggggaccactttgtacaagaaagctgggttctcgtatttaggcaact

SEQ ID NO: 11732 - DNA, 47 bp, Artificial Sequence
  Amplification primer (reverse)
ggggaccactttgtacaagaaagctgggttattggatatgccataaa

SEQ ID NO: 11733 - DNA, 50 bp, Artificial Sequence
  Amplification primer (reverse)
ggggaccactttgtacaagaaagctgggttgactttttgatgtttacttt

SEQ ID NO: 11734 - DNA, 52 bp, Artificial Sequence
  Amplification primer (reverse)
ggggaccactttgtacaagaaagctgggttttctttactataaacatcttca

SEQ ID NO: 11735 - DNA, 49 bp, Artificial Sequence
  Amplification primer (reverse)
ggggaccactttgtacaagaaagctgggttagcatttaaagttgaatgt

SEQ ID NO: 11736 - DNA, 49 bp, Artificial Sequence
  Amplification primer (reverse)
ggggaccactttgtacaagaaagctgggttgttagtctcttcaagatca

SEQ ID NO: 11737 - DNA, 46 bp, Artificial Sequence
  Amplification primer (reverse)
ggggaccactttgtacaagaaagctgggttaagacctaccgcccaa

SEQ ID NO: 11738 - DNA, 50 bp, Artificial Sequence
  Amplification primer (reverse)
ggggaccactttgtacaagaaagctgggtttacttctttctctttcaatt

SEQ ID NO: 11739 - DNA, 48 bp, Artificial Sequence
  Amplification primer (reverse)
ggggaccactttgtacaagaaagctgggttcttagtgttccgatatga

SEQ ID NO: 11740 - DNA, 48 bp, Artificial Sequence
  Amplification primer (reverse)
ggggaccactttgtacaagaaagctgggtttcttgttttaagagcaga

SEQ ID NO: 11741 - DNA, 48 bp, Artificial Sequence; identical to SEQ ID NO: 11740
  Amplification primer (reverse)

SEQ ID NO: 11742 - DNA, 47 bp, Artificial Sequence
  Amplification primer (reverse)
ggggaccactttgtacaagaaagctgggttatcatgttttccctcaa

SEQ ID NO: 11743 - DNA, 50 bp, Artificial Sequence
  Amplification primer (reverse)
ggggaccactttgtacaagaaagctgggttatctgatatatccgttttat

SEQ ID NO: 11744 - DNA, 49 bp, Artificial Sequence
  Amplification primer (reverse)
ggggaccactttgtacaagaaagctgggttttttttgtctcctttttta

SEQ ID NO: 11745 - DNA, 50 bp, Artificial Sequence
  Amplification primer (reverse)
ggggaccactttgtacaagaaagctgggttaaagacacgataaacataag

SEQ ID NO: 11746 - DNA, 50 bp, Artificial Sequence; identical to SEQ ID NO: 11745
  Amplification primer (reverse)

SEQ ID NO: 11747 - DNA, 49 bp, Artificial Sequence
  Amplification primer (reverse)
ggggaccactttgtacaagaaagctgggttatttgcaacttcttgtata

SEQ ID NO: 11748 - DNA, 52 bp, Artificial Sequence
  Amplification primer (reverse)
ggggaccactttgtacaagaaagctgggtttttaaaagtatccttaaataag

SEQ ID NO: 11749 - DNA, 48 bp, Artificial Sequence
  Amplification primer (reverse)
ggggaccactttgtacaagaaagctgggttcttcctcctcaatagttg

SEQ ID NO: 11750 - DNA, 46 bp, Artificial Sequence
  Amplification primer (reverse)
ggggaccactttgtacaagaaagctgggttttctcctcccccatta

SEQ ID NO: 11751 - DNA, 47 bp, Artificial Sequence
  Amplification primer (reverse)
ggggaccactttgtacaagaaagctgggttatccaaacgagtgaaat

SEQ ID NO: 11752 - DNA, 48 bp, Artificial Sequence
  Amplification primer (reverse)
ggggaccactttgtacaagaaagctgggttaggtgttgttgtattttc

SEQ ID NO: 11753 - DNA, 52 bp, Artificial Sequence
  Amplification primer (reverse)
ggggaccactttgtacaagaaagctgggttctttctaagtttattaaacata

SEQ ID NO: 11754 - DNA, 46 bp, Artificial Sequence
  Amplification primer (reverse)
ggggaccactttgtacaagaaagctgggttggcatctgttaccttg

SEQ ID NO: 11755 - DNA, 49 bp, Artificial Sequence
  Amplification primer (reverse)
ggggaccactttgtacaagaaagctgggttaaacaactccattattttt

SEQ ID NO: 11756 - DNA, 47 bp, Artificial Sequence
  Amplification primer (reverse)
ggggaccactttgtacaagaaagctgggtttaaacgttgaagagcat

SEQ ID NO: 11757 - DNA, 52 bp, Artificial Sequence
  Amplification primer (reverse)
ggggaccactttgtacaagaaagctgggttcttatcatatcttgttaaatca

SEQ ID NO: 11758 - DNA, 52 bp, Artificial Sequence; identical to SEQ ID NO: 11757
  Amplification primer (reverse)

SEQ ID NO: 11759 - DNA, 46 bp, Artificial Sequence
  Amplification primer (reverse)
ggggaccactttgtacaagaaagctgggttttgccatgggttatag

SEQ ID NO: 11760 - DNA, 49 bp, Artificial Sequence
  Amplification primer (reverse)
ggggaccactttgtacaagaaagctgggttagaattaaaattttcatgc

SEQ ID NO: 11761 - DNA, 49 bp, Artificial Sequence; identical to SEQ ID NO: 11760
  Amplification primer (reverse)

SEQ ID NO: 11762 - DNA, 50 bp, Artificial Sequence
  Amplification primer (reverse)
ggggaccactttgtacaagaaagctgggttttttttagatgttttatgtg

SEQ ID NO: 11763 - DNA, 49 bp, Artificial Sequence
  Amplification primer (reverse)
ggggaccactttgtacaagaaagctgggttctcttttactttagcttca

SEQ ID NO: 11764 - DNA, 46 bp, Artificial Sequence
  Amplification primer (reverse)
ggggaccactttgtacaagaaagctgggtttttcaaactccagcca

SEQ ID NO: 11765 - DNA, 46 bp, Artificial Sequence
  Amplification primer (reverse)
ggggaccactttgtacaagaaagctgggttggagtgcctttctact

SEQ ID NO: 11766 - DNA, 48 bp, Artificial Sequence
  Amplification primer (reverse)
ggggaccactttgtacaagaaagctgggttttcatatcgtaaagcatc

SEQ ID NO: 11767 - DNA, 46 bp, Artificial Sequence
  Amplification primer (reverse)
ggggaccactttgtacaagaaagctgggttatcgtcaaccttaacg

SEQ ID NO: 11768 - DNA, 48 bp, Artificial Sequence
  Amplification primer (reverse)
ggggaccactttgtacaagaaagctgggttttttacttgacgtctcac

SEQ ID NO: 11769 - DNA, 49 bp, Artificial Sequence
  Amplification primer (reverse)
ggggaccactttgtacaagaaagctgggttgtcttccattaatattccc

SEQ ID NO: 11770 - DNA, 49 bp, Artificial Sequence
  Amplification primer (reverse)
ggggaccactttgtacaagaaagctgggttccaattattttgaaagttc

SEQ ID NO: 11771 - DNA, 52 bp, Artificial Sequence
  Amplification primer (reverse)
ggggaccactttgtacaagaaagctgggttatttttttgaataatataatcc

SEQ ID NO: 11772 - DNA, 48 bp, Artificial Sequence
  Amplification primer (reverse)
ggggaccactttgtacaagaaagctgggtttttattatcagaaaaggc

SEQ ID NO: 11773 - DNA, 48 bp, Artificial Sequence
  Amplification primer (reverse)
ggggaccactttgtacaagaaagctgggttattcaaaaaatttttcaa

SEQ ID NO: 11774 - DNA, 46 bp, Artificial Sequence
  Amplification primer (reverse)
ggggaccactttgtacaagaaagctgggttcgaaacgtcaggtaaa

SEQ ID NO: 11775 - DNA, 53 bp, Artificial Sequence
  Amplification primer (reverse)
ggggaccactttgtacaagaaagctgggttacttatttttgataatatttctt

SEQ ID NO: 11776 - DNA, 47 bp, Artificial Sequence
  Amplification primer (reverse)
ggggaccactttgtacaagaaagctgggttatcagcatttctacgaa

SEQ ID NO: 11777 - DNA, 50 bp, Artificial Sequence
  Amplification primer (reverse)
ggggaccactttgtacaagaaagctgggttatgtagactcctaatgattt

SEQ ID NO: 11778 - DNA, 47 bp, Artificial Sequence
  Amplification primer (reverse)
ggggaccactttgtacaagaaagctgggtttttactgttcctttcgc

SEQ ID NO: 11779 - DNA, 52 bp, Artificial Sequence
  Amplification primer (reverse)
ggggaccactttgtacaagaaagctgggttgagattaatttgattatatttt

SEQ ID NO: 11780 - DNA, 46 bp, Artificial Sequence
  Amplification primer (reverse)
ggggaccactttgtacaagaaagctgggttaacatcatttcctccc

SEQ ID NO: 11781 - DNA, 48 bp, Artificial Sequence
  Amplification primer (reverse)
ggggaccactttgtacaagaaagctgggttgttgatagttccaaaacg

SEQ ID NO: 11782 - DNA, 51 bp, Artificial Sequence
  Amplification primer (reverse)
ggggaccactttgtacaagaaagctgggtttaaatgtgttcctactaaatt

SEQ ID NO: 11783 - DNA, 47 bp, Artificial Sequence
  Amplification primer (reverse)
ggggaccactttgtacaagaaagctgggttcatcaatagccgagctg

SEQ ID NO: 11784 - DNA, 48 bp, Artificial Sequence
  Amplification primer (reverse)
ggggaccactttgtacaagaaagctgggtttttattttccaaatgaca

SEQ ID NO: 11785 - DNA, 47 bp, Artificial Sequence
  Amplification primer (reverse)
ggggaccactttgtacaagaaagctgggttttcactcggagttggag

SEQ ID NO: 11786 - DNA, 47 bp, Artificial Sequence; identical to SEQ ID NO: 11785
  Amplification primer (reverse)

SEQ ID NO: 11787 - DNA, 49 bp, Artificial Sequence
  Amplification primer (reverse)
ggggaccactttgtacaagaaagctgggttaatgtaaatgacaaaggta

SEQ ID NO: 11788 - DNA, 47 bp, Artificial Sequence
  Amplification primer (reverse)
ggggaccactttgtacaagaaagctgggttgttttttaatggtttgc

SEQ ID NO: 11789 - DNA, 50 bp, Artificial Sequence
  Amplification primer (reverse)
ggggaccactttgtacaagaaagctgggtttttatcataagcatctagac

SEQ ID NO: 11790 - DNA, 48 bp, Artificial Sequence
  Amplification primer (reverse)
ggggaccactttgtacaagaaagctgggttctgatctcttgttgatgc

SEQ ID NO: 11791 - DNA, 46 bp, Artificial Sequence
  Amplification primer (reverse)
ggggaccactttgtacaagaaagctgggttaagcaggggagcaata

SEQ ID NO: 11792 - DNA, 46 bp, Artificial Sequence; identical to SEQ ID NO: 11791
  Amplification primer (reverse)

SEQ ID NO: 11793 - DNA, 46 bp, Artificial Sequence
  Amplification primer (reverse)
ggggaccactttgtacaagaaagctgggttctgagcaacacctgtc

SEQ ID NO: 11794 - DNA, 46 bp, Artificial Sequence
  Amplification primer (reverse)
ggggaccactttgtacaagaaagctgggttggcaattttgtggcaa

SEQ ID NO: 11795 - DNA, 47 bp, Artificial Sequence
  Amplification primer (reverse)
ggggaccactttgtacaagaaagctgggttttgcttagttaatggct

SEQ ID NO: 11796 - DNA, 48 bp, Artificial Sequence
  Amplification primer (reverse)
ggggaccactttgtacaagaaagctgggttaggcgttgaatataattc

SEQ ID NO: 11797 - DNA, 48 bp, Artificial Sequence; identical to SEQ ID NO: 11796
  Amplification primer (reverse)

SEQ ID NO: 11798 - DNA, 47 bp, Artificial Sequence
  Amplification primer (reverse)
ggggaccactttgtacaagaaagctgggttcttttcaactccaaaca

SEQ ID NO: 11799 - DNA, 48 bp, Artificial Sequence
  Amplification primer (reverse)
ggggaccactttgtacaagaaagctgggttgagttgtctttttttgtc

SEQ ID NO: 11800 - DNA, 47 bp, Artificial Sequence
  Amplification primer (reverse)
ggggaccactttgtacaagaaagctgggttgcaatcacaattgacat

SEQ ID NO: 11801 - DNA, 47 bp, Artificial Sequence
  Amplification primer (reverse)
ggggaccactttgtacaagaaagctgggttctttgtctgcttcactt

SEQ ID NO: 11802 - DNA, 48 bp, Artificial Sequence
  Amplification primer (reverse)
ggggaccactttgtacaagaaagctgggttttgtatcttctcctgacc

SEQ ID NO: 11803 - DNA, 46 bp, Artificial Sequence
  Amplification primer (reverse)
ggggaccactttgtacaagaaagctgggttttggttaatcgtcttg

SEQ ID NO: 11804 - DNA, 46 bp, Artificial Sequence; identical to SEQ ID NO: 11803
  Amplification primer (reverse)

SEQ ID NO: 11805 - DNA, 51 bp, Artificial Sequence
  Amplification primer (reverse)
ggggaccactttgtacaagaaagctgggtttttagttactttcataaatgg

SEQ ID NO: 11806 - DNA, 51 bp, Artificial Sequence; identical to SEQ ID NO: 11805
  Amplification primer (reverse)

SEQ ID NO: 11807 - DNA, 52 bp, Artificial Sequence
  Amplification primer (reverse)
ggggaccactttgtacaagaaagctgggttatataattcctctaaaactagc

SEQ ID NO: 11808 - DNA, 49 bp, Artificial Sequence
  Amplification primer (reverse)
ggggaccactttgtacaagaaagctgggttccacttcaaattaactaac

SEQ ID NO: 11809 - DNA, 46 bp, Artificial Sequence
  Amplification primer (reverse)
ggggaccactttgtacaagaaagctgggttattccttgaacacgaa

SEQ ID NO: 11810 - DNA, 46 bp, Artificial Sequence
  Amplification primer (reverse)
ggggaccactttgtacaagaaagctgggttgtgccattcattctct

SEQ ID NO: 11811 - DNA, 47 bp, Artificial Sequence
  Amplification primer (reverse)
ggggaccactttgtacaagaaagctgggttttgtcctgtgaactgtg

SEQ ID NO: 11812 - DNA, 48 bp, Artificial Sequence
  Amplification primer (reverse)
ggggaccactttgtacaagaaagctgggttagggtttatttgttgaag

SEQ ID NO: 11813 - DNA, 47 bp, Artificial Sequence
  Amplification primer (reverse)
ggggaccactttgtacaagaaagctgggtttcctgatttatccactg

SEQ ID NO: 11814 - DNA, 48 bp, Artificial Sequence; identical to SEQ ID NO: 11812
  Amplification primer (reverse)

SEQ ID NO: 11815 - DNA, 48 bp, Artificial Sequence
  Amplification primer (reverse)
ggggaccactttgtacaagaaagctgggttcaaaatacctaagctagc

SEQ ID NO: 11816 - DNA, 46 bp, Artificial Sequence
  Amplification primer (reverse)
ggggaccactttgtacaagaaagctgggttacgaacttccataacc

SEQ ID NO: 11817 - DNA, 46 bp, Artificial Sequence
  Amplification primer (reverse)
ggggaccactttgtacaagaaagctgggttggcttctccaatcaaa

SEQ ID NO: 11818 - DNA, 48 bp, Artificial Sequence
  Amplification primer (reverse)
ggggaccactttgtacaagaaagctgggttttgagttaatggattgtt

SEQ ID NO: 11819 - DNA, 48 bp, Artificial Sequence
  Amplification primer (reverse)
ggggaccactttgtacaagaaagctgggtttagcgttatttcactgtg

SEQ ID NO: 11820 - DNA, 46 bp, Artificial Sequence
  Amplification primer (reverse)
ggggaccactttgtacaagaaagctgggtttttctccgcccagtca

SEQ ID NO: 11821 - DNA, 49 bp, Artificial Sequence
  Amplification primer (reverse)
ggggaccactttgtacaagaaagctgggttccgtttattctttctactg

SEQ ID NO: 11822 - DNA, 48 bp, Artificial Sequence
  Amplification primer (reverse)
ggggaccactttgtacaagaaagctgggttcatatctgttgcatcaat

SEQ ID NO: 11823 - DNA, 48 bp, Artificial Sequence
  Amplification primer (reverse)
ggggaccactttgtacaagaaagctgggttaactggctttttagtcag

SEQ ID NO: 11824 - DNA, 52 bp, Artificial Sequence
  Amplification primer (reverse)
ggggaccactttgtacaagaaagctgggtttttattatttaattcttcaata

SEQ ID NO: 11825 - DNA, 47 bp, Artificial Sequence
  Amplification primer (reverse)
ggggaccactttgtacaagaaagctgggttgtcttttagagcatcga

SEQ ID NO: 11826 - DNA, 49 bp, Artificial Sequence
  Amplification primer (reverse)
ggggaccactttgtacaagaaagctgggttctctcctctaagactttcg

SEQ ID NO: 11827 - DNA, 48 bp, Artificial Sequence
  Amplification primer (reverse)
ggggaccactttgtacaagaaagctgggtttccttttgttacttttgc

SEQ ID NO: 11828 - DNA, 46 bp, Artificial Sequence
  Amplification primer (reverse)
ggggaccactttgtacaagaaagctgggtttttatcgcctttgttg

SEQ ID NO: 11829 - DNA, 46 bp, Artificial Sequence
  Amplification primer (reverse)
ggggaccactttgtacaagaaagctgggttatgttcaggttctccg

SEQ ID NO: 11830 - DNA, 49 bp, Artificial Sequence
  Amplification primer (reverse)
ggggaccactttgtacaagaaagctgggttttccattatcttcaagtta

SEQ ID NO: 11831 - DNA, 49 bp, Artificial Sequence
  Amplification primer (reverse)
ggggaccactttgtacaagaaagctgggttctcttcttcatttttctta

SEQ ID NO: 11832 - DNA, 50 bp, Artificial Sequence
  Amplification primer (reverse)
ggggaccactttgtacaagaaagctgggtttttttttaagttgtagaatg

SEQ ID NO: 11833 - DNA, 48 bp, Artificial Sequence
  Amplification primer (reverse)
ggggaccactttgtacaagaaagctgggttgttttttgatgcttcttg

SEQ ID NO: 11834 - DNA, 48 bp, Artificial Sequence
  Amplification primer (reverse)
ggggaccactttgtacaagaaagctgggtttttactactttggttggc

SEQ ID NO: 11835 - DNA, 47 bp, Artificial Sequence
  Amplification primer (reverse)
ggggaccactttgtacaagaaagctgggttgtgtgtcattttgacct

SEQ ID NO: 11836 - DNA, 48 bp, Artificial Sequence
  Amplification primer (reverse)
ggggaccactttgtacaagaaagctgggtttccttcaagatcatttaa

SEQ ID NO: 11837 - DNA, 48 bp, Artificial Sequence
  Amplification primer (reverse)
ggggaccactttgtacaagaaagctgggttacctccttttctttcatt

SEQ ID NO: 11838 - DNA, 49 bp, Artificial Sequence
  Amplification primer (reverse)
ggggaccactttgtacaagaaagctgggttatcttctcctaacttaccc

SEQ ID NO: 11839 - DNA, 50 bp, Artificial Sequence
  Amplification primer (reverse)
ggggaccactttgtacaagaaagctgggttactagctagattcttaacgc

SEQ ID NO: 11840 - DNA, 49 bp, Artificial Sequence; identical to SEQ ID NO: 11838
  Amplification primer (reverse)

SEQ ID NO: 11841 - DNA, 46 bp, Artificial Sequence
  Amplification primer (reverse)
ggggaccactttgtacaagaaagctgggttgcctctttctccaaat

SEQ ID NO: 11842 - DNA, 50 bp, Artificial Sequence
  Amplification primer (reverse)
ggggaccactttgtacaagaaagctgggttatgtcctgttatatcttctt

SEQ ID NO: 11843 - DNA, 46 bp, Artificial Sequence
  Amplification primer (reverse)
ggggaccactttgtacaagaaagctgggttgcgttgaataatggtt

SEQ ID NO: 11844 - DNA, 50 bp, Artificial Sequence
  Amplification primer (reverse)
ggggaccactttgtacaagaaagctgggtttatttctttagtttcttcaa

SEQ ID NO: 11845 - DNA, 53 bp, Artificial Sequence
  Amplification primer (reverse)
ggggaccactttgtacaagaaagctgggtttaataaaaattatataagaacct

SEQ ID NO: 11846 - DNA, 50 bp, Artificial Sequence
  Amplification primer (reverse)
ggggaccactttgtacaagaaagctgggttttctgtcttataagcataag

SEQ ID NO: 11847 - DNA, 49 bp, Artificial Sequence
  Amplification primer (reverse)
ggggaccactttgtacaagaaagctgggttttttttataagcatgtgta

SEQ ID NO: 11848 - DNA, 48 bp, Artificial Sequence
  Amplification primer (reverse)
ggggaccactttgtacaagaaagctgggttatgagacataaggtcttg

SEQ ID NO: 11849 - DNA, 46 bp, Artificial Sequence
  Amplification primer (reverse)
ggggaccactttgtacaagaaagctgggttgttggagctcctactg

SEQ ID NO: 11850 - DNA, 46 bp, Artificial Sequence; identical to SEQ ID NO: 11849
  Amplification primer (reverse)

SEQ ID NO: 11851 - DNA, 48 bp, Artificial Sequence
  Amplification primer (reverse)
ggggaccactttgtacaagaaagctgggttcatttctttggttaaagc

SEQ ID NO: 11852 - DNA, 48 bp, Artificial Sequence
  Amplification primer (reverse)
ggggaccactttgtacaagaaagctgggtttatctcgagtgctatttg

SEQ ID NO: 11853 - DNA, 49 bp, Artificial Sequence
  Amplification primer (reverse)
ggggaccactttgtacaagaaagctgggttctcttcatcgacatagtaa

SEQ ID NO: 11854 - DNA, 48 bp, Artificial Sequence; identical to SEQ ID NO: 11852
  Amplification primer (reverse)

SEQ ID NO: 11855 - DNA, 50 bp, Artificial Sequence
  Amplification primer (reverse)
ggggaccactttgtacaagaaagctgggttattttacagtagtggagttt

SEQ ID NO: 11856 - DNA, 46 bp, Artificial Sequence
  Amplification primer (reverse)
ggggaccactttgtacaagaaagctgggtttgtcctcattttttca

SEQ ID NO: 11857 - DNA, 48 bp, Artificial Sequence
  Amplification primer (reverse)
ggggaccactttgtacaagaaagctgggtttttaacagtacgaacacg

SEQ ID NO: 11858 - DNA, 47 bp, Artificial Sequence
  Amplification primer (reverse)
ggggaccactttgtacaagaaagctgggttccccctgtttttaaaat

SEQ ID NO: 11859 - DNA, 46 bp, Artificial Sequence
  Amplification primer (reverse)
ggggaccactttgtacaagaaagctgggttaccctcatatgattcc

SEQ ID NO: 11860 - DNA, 51 bp, Artificial Sequence
  Amplification primer (reverse)
ggggaccactttgtacaagaaagctgggtttttaaaataatgatacatctc

SEQ ID NO: 11861 - DNA, 51 bp, Artificial Sequence; identical to SEQ ID NO: 11860
  Amplification primer (reverse)

SEQ ID NO: 11862 - DNA, 46 bp, Artificial Sequence
  Amplification primer (reverse)
ggggaccactttgtacaagaaagctgggtttaaccccgtctcaaca

SEQ ID NO: 11863 - DNA, 48 bp, Artificial Sequence
  Amplification primer (reverse)
ggggaccactttgtacaagaaagctgggtttattttcgttttctcaaa

SEQ ID NO: 11864 - DNA, 49 bp, Artificial Sequence
  Amplification primer (reverse)
ggggaccactttgtacaagaaagctgggtttttctccaaataatctctc

SEQ ID NO: 11865 - DNA, 51 bp, Artificial Sequence
  Amplification primer (reverse)
ggggaccactttgtacaagaaagctgggttcctacttttagttttagaaga

SEQ ID NO: 11866 - DNA, 46 bp, Artificial Sequence
  Amplification primer (reverse)
ggggaccactttgtacaagaaagctgggttgaaatcatagcttccc

SEQ ID NO: 11867 - DNA, 49 bp, Artificial Sequence
  Amplification primer (reverse)
ggggaccactttgtacaagaaagctgggttaccttttacttttggtagt

SEQ ID NO: 11868 - DNA, 49 bp, Artificial Sequence; identical to SEQ ID NO: 11867
  Amplification primer (reverse)

SEQ ID NO: 11869 - DNA, 49 bp, Artificial Sequence
  Amplification primer (reverse)
ggggaccactttgtacaagaaagctgggttttgtttgtgaagtaaaacg

SEQ ID NO: 11870 - DNA, 50 bp, Artificial Sequence
  Amplification primer (reverse)
ggggaccactttgtacaagaaagctgggtttaatttaaaaattgcataaa

SEQ ID NO: 11871 - DNA, 49 bp, Artificial Sequence
  Amplification primer (reverse)
ggggaccactttgtacaagaaagctgggtttttcgttaccatatctaga

SEQ ID NO: 11872 - DNA, 48 bp, Artificial Sequence
  Amplification primer (reverse)
ggggaccactttgtacaagaaagctgggtttaaatcatggaaactagc

SEQ ID NO: 11873 - DNA, 46 bp, Artificial Sequence
  Amplification primer (reverse)
ggggaccactttgtacaagaaagctgggttaaagcccaaccttccg

SEQ ID NO: 11874 - DNA, 46 bp, Artificial Sequence
  Amplification primer (reverse)
ggggaccactttgtacaagaaagctgggttgtttccacgtcctttc

SEQ ID NO: 11875 - DNA, 48 bp, Artificial Sequence
  Amplification primer (reverse)
ggggaccactttgtacaagaaagctgggttaagtttattcaaatctgg

SEQ ID NO: 11876 - DNA, 50 bp, Artificial Sequence
  Amplification primer (reverse)
ggggaccactttgtacaagaaagctgggttaatgtaatggttttttaata

SEQ ID NO: 11877 - DNA, 49 bp, Artificial Sequence
  Amplification primer (reverse)
ggggaccactttgtacaagaaagctgggttagctaaaatacctaaccag

SEQ ID NO: 11878 - DNA, 48 bp, Artificial Sequence
  Amplification primer (reverse)
ggggaccactttgtacaagaaagctgggttattttttaaacgactcat

SEQ ID NO: 11879 - DNA, 46 bp, Artificial Sequence
  Amplification primer (reverse)
ggggaccactttgtacaagaaagctgggttagcggaacggtgaata

SEQ ID NO: 11880 - DNA, 51 bp, Artificial Sequence
  Amplification primer (reverse)
ggggaccactttgtacaagaaagctgggttataatctaaactatcagctct

SEQ ID NO: 11881 - DNA, 50 bp, Artificial Sequence
  Amplification primer (reverse)
ggggaccactttgtacaagaaagctgggttatctcctattgtaattttga

SEQ ID NO: 11882 - DNA, 50 bp, Artificial Sequence; identical to SEQ ID NO: 11881
  Amplification primer (reverse)

SEQ ID NO: 11883 - DNA, 46 bp, Artificial Sequence
  Amplification primer (reverse)
ggggaccactttgtacaagaaagctgggttcacctcttttgtcaga

SEQ ID NO: 11884 - DNA, 48 bp, Artificial Sequence
  Amplification primer (reverse)
ggggaccactttgtacaagaaagctgggtttttgttagcgagtaagtc

SEQ ID NO: 11885 - DNA, 50 bp, Artificial Sequence
  Amplification primer (reverse)
ggggaccactttgtacaagaaagctgggtttttatcatcctccttaataa

SEQ ID NO: 11886 - DNA, 50 bp, Artificial Sequence
  Amplification primer (reverse)
ggggaccactttgtacaagaaagctgggttaaacgttttactctgtaaaa

SEQ ID NO: 11887 - DNA, 51 bp, Artificial Sequence
  Amplification primer (reverse)
ggggaccactttgtacaagaaagctgggttaaataagaatgttaaaagagc

SEQ ID NO: 11888 - DNA, 46 bp, Artificial Sequence
  Amplification primer (reverse)
ggggaccactttgtacaagaaagctgggttttccccaaaaatttct

SEQ ID NO: 11889 - DNA, 46 bp, Artificial Sequence
  Amplification primer (reverse)
ggggaccactttgtacaagaaagctgggttacgcagtcccattttc

SEQ ID NO: 11890 - DNA, 46 bp, Artificial Sequence
  Amplification primer (reverse)
ggggaccactttgtacaagaaagctgggttctggcatgaggtctca

SEQ ID NO: 11891 - DNA, 48 bp, Artificial Sequence
  Amplification primer (reverse)
ggggaccactttgtacaagaaagctgggttccttttttcaataatagc

SEQ ID NO: 11892 - DNA, 49 bp, Artificial Sequence
  Amplification primer (reverse)
ggggaccactttgtacaagaaagctgggttatctttaatcttaccatcc

SEQ ID NO: 11893 - DNA, 46 bp, Artificial Sequence
  Amplification primer (reverse)
ggggaccactttgtacaagaaagctgggtttgctgctactgcaatg

SEQ ID NO: 11894 - DNA, 49 bp, Artificial Sequence; identical to SEQ ID NO: 11892
  Amplification primer (reverse)

SEQ ID NO: 11895 - DNA, 50 bp, Artificial Sequence
  Amplification primer (reverse)
ggggaccactttgtacaagaaagctgggtttaaattcctttgttgtaata

SEQ ID NO: 11896 - DNA, 46 bp, Artificial Sequence
  Amplification primer (reverse)
ggggaccactttgtacaagaaagctgggttaccatcagttgtcacc

SEQ ID NO: 11897 - DNA, 46 bp, Artificial Sequence
  Amplification primer (reverse)
ggggaccactttgtacaagaaagctgggtttattgaccagtgcacg

SEQ ID NO: 11898 - DNA, 50 bp, Artificial Sequence
  Amplification primer (reverse)
ggggaccactttgtacaagaaagctgggtttttttttgaatttgtaaaag

SEQ ID NO: 11899 - DNA, 52 bp, Artificial Sequence
  Amplification primer (reverse)
ggggaccactttgtacaagaaagctgggttagagattatttttattttaaat

SEQ ID NO: 11900 - DNA, 52 bp, Artificial Sequence
  Amplification primer (reverse)
ggggaccactttgtacaagaaagctgggtttttatttttagtatctaaaacg

SEQ ID NO: 11901 - DNA, 51 bp, Artificial Sequence
  Amplification primer (reverse)
ggggaccactttgtacaagaaagctgggtttttagaaactccaagtatctc

SEQ ID NO: 11902 - DNA, 53 bp, Artificial Sequence
  Amplification primer (reverse)
ggggaccactttgtacaagaaagctgggttgttaatttgactattgatatatt

SEQ ID NO: 11903 - DNA, 50 bp, Artificial Sequence
  Amplification primer (reverse)
ggggaccactttgtacaagaaagctgggtttaaactctcaaaagctaaac

SEQ ID NO: 11904 - DNA, 46 bp, Artificial Sequence
  Amplification primer (reverse)
ggggaccactttgtacaagaaagctgggttacgttcttctctggct

SEQ ID NO: 11905 - DNA, 47 bp, Artificial Sequence
  Amplification primer (reverse)
ggggaccactttgtacaagaaagctgggttacttaaatggaacaacc

SEQ ID NO: 11906 - DNA, 48 bp, Artificial Sequence
  Amplification primer (reverse)
ggggaccactttgtacaagaaagctgggtttttgcctaaaaaattagg

SEQ ID NO: 11907 - DNA, 46 bp, Artificial Sequence
  Amplification primer (reverse)
ggggaccactttgtacaagaaagctgggttggctttcctcccttca

SEQ ID NO: 11908 - DNA, 49 bp, Artificial Sequence
  Amplification primer (reverse)
ggggaccactttgtacaagaaagctgggttttcatctttttcaatatca

SEQ ID NO: 11909 - DNA, 48 bp, Artificial Sequence
  Amplification primer (reverse)
ggggaccactttgtacaagaaagctgggttgtgagagtgtctttgttt

SEQ ID NO: 11910 - DNA, 50 bp, Artificial Sequence
  Amplification primer (reverse)
ggggaccactttgtacaagaaagctgggttcagatttttagctacttgtc

SEQ ID NO: 11911 - DNA, 48 bp, Artificial Sequence
  Amplification primer (reverse)
ggggaccactttgtacaagaaagctgggtttctagagcgctttataag

SEQ ID NO: 11912 - DNA, 50 bp, Artificial Sequence
  Amplification primer (reverse)
ggggaccactttgtacaagaaagctgggttttttctaatagttagaagcc

SEQ ID NO: 11913 - DNA, 47 bp, Artificial Sequence
  Amplification primer (reverse)
ggggaccactttgtacaagaaagctgggttttttaaatgtgcagaga

SEQ ID NO: 11914 - DNA, 48 bp, Artificial Sequence
  Amplification primer (reverse)
ggggaccactttgtacaagaaagctgggttatttataatttccttggg

SEQ ID NO: 11915 - DNA, 53 bp, Artificial Sequence
  Amplification primer (reverse)
ggggaccactttgtacaagaaagctgggtttctataatatctctctaaagtga

SEQ ID NO: 11916 - DNA, 47 bp, Artificial Sequence
  Amplification primer (reverse)
ggggaccactttgtacaagaaagctgggttcctcgctaacatatcac

SEQ ID NO: 11917 - DNA, 47 bp, Artificial Sequence
  Amplification primer (reverse)
ggggaccactttgtacaagaaagctgggttagctcttacagtcttgc

SEQ ID NO: 11918 - DNA, 46 bp, Artificial Sequence
  Amplification primer (reverse)
ggggaccactttgtacaagaaagctgggttttgtctgagtgaccaa

SEQ ID NO: 11919 - DNA, 52 bp, Artificial Sequence
  Amplification primer (reverse)
ggggaccactttgtacaagaaagctgggttataatatgaaatatgttgttca

SEQ ID NO: 11920 - DNA, 46 bp, Artificial Sequence
  Amplification primer (reverse)
ggggaccactttgtacaagaaagctgggtttccgcagagtaaaaaa

SEQ ID NO: 11921 - DNA, 46 bp, Artificial Sequence
  Amplification primer (reverse)
ggggaccactttgtacaagaaagctgggttttcataaatgtgccaa

SEQ ID NO: 11922 - DNA, 46 bp, Artificial Sequence
  Amplification primer (reverse)
ggggaccactttgtacaagaaagctgggttttcatctctgctcacc

SEQ ID NO: 11923 - DNA, 47 bp, Artificial Sequence
  Amplification primer (reverse)
ggggaccactttgtacaagaaagctgggttttctccttcagctttta

SEQ ID NO: 11924 - DNA, 50 bp, Artificial Sequence
  Amplification primer (reverse)
ggggaccactttgtacaagaaagctgggttgtcattttttctaaagtttg

SEQ ID NO: 11925 - DNA, 49 bp, Artificial Sequence
  Amplification primer (reverse)
ggggaccactttgtacaagaaagctgggtttttttgtagttgtttcaat

SEQ ID NO: 11926 - DNA, 52 bp, Artificial Sequence
  Amplification primer (reverse)
ggggaccactttgtacaagaaagctgggtttttcattagataactattcagc

SEQ ID NO: 11927 - DNA, 54 bp, Artificial Sequence
  Amplification primer (reverse)
ggggaccactttgtacaagaaagctgggtttatagactgaagataattaattaa

SEQ ID NO: 11928 - DNA, 48 bp, Artificial Sequence
  Amplification primer (reverse)
ggggaccactttgtacaagaaagctgggttaaatcgattaatcaagtc

SEQ ID NO: 11929 - DNA, 52 bp, Artificial Sequence
  Amplification primer (reverse)
ggggaccactttgtacaagaaagctgggtttctaaagtagtcctttagacta

SEQ ID NO: 11930 - DNA, 52 bp, Artificial Sequence; identical to SEQ ID NO: 11929
  Amplification primer (reverse)

SEQ ID NO: 11931 - DNA, 48 bp, Artificial Sequence
  Amplification primer (reverse)
ggggaccactttgtacaagaaagctgggtttttgtccataatcatttc

SEQ ID NO: 11932 - DNA, 49 bp, Artificial Sequence
  Amplification primer (reverse)
ggggaccactttgtacaagaaagctgggttggtagatatgcctaacatt

SEQ ID NO: 11933 - DNA, 46 bp, Artificial Sequence
  Amplification primer (reverse)
ggggaccactttgtacaagaaagctgggttgtttccttccaaaaaa

SEQ ID NO: 11934 - DNA, 46 bp, Artificial Sequence
  Amplification primer (reverse)
ggggaccactttgtacaagaaagctgggtttccatgcttaatagcc

SEQ ID NO: 11935 - DNA, 50 bp, Artificial Sequence
  Amplification primer (reverse)
ggggaccactttgtacaagaaagctgggttatctaaaccaatttctgtac

SEQ ID NO: 11936 - DNA, 46 bp, Artificial Sequence
  Amplification primer (reverse)
ggggaccactttgtacaagaaagctgggttgtccacaaaaacgtct

SEQ ID NO: 11937 - DNA, 48 bp, Artificial Sequence
  Amplification primer (reverse)
ggggaccactttgtacaagaaagctgggtttagatgttctacggagaa

SEQ ID NO: 11938 - DNA, 46 bp, Artificial Sequence
  Amplification primer (reverse)
ggggaccactttgtacaagaaagctgggttaaagatggcaagccat

SEQ ID NO: 11939 - DNA, 47 bp, Artificial Sequence
  Amplification primer (reverse)
ggggaccactttgtacaagaaagctgggtttctctctccacaccata

SEQ ID NO: 11940 - DNA, 46 bp, Artificial Sequence
  Amplification primer (reverse)
ggggaccactttgtacaagaaagctgggttcttacctcctgtggct

SEQ ID NO: 11941 - DNA, 47 bp, Artificial Sequence
  Amplification primer (reverse)
ggggaccactttgtacaagaaagctgggttcttttgttggttacctc

SEQ ID NO: 11942 - DNA, 52 bp, Artificial Sequence
  Amplification primer (reverse)
ggggaccactttgtacaagaaagctgggtttattgttaaatatgatgaaatg

SEQ ID NO: 11943 - DNA, 52 bp, Artificial Sequence
  Amplification primer (reverse)
ggggaccactttgtacaagaaagctgggttatgattatacaaattgattaat

SEQ ID NO: 11944 - DNA, 52 bp, Artificial Sequence; identical to SEQ ID NO: 11943
  Amplification primer (reverse)

SEQ ID NO: 11945 - DNA, 46 bp, Artificial Sequence
  Amplification primer (reverse)
ggggaccactttgtacaagaaagctgggtttccctcttccttgaca

SEQ ID NO: 11946 - DNA, 46 bp, Artificial Sequence
  Amplification primer (reverse)
ggggaccactttgtacaagaaagctgggttaacgtttttgagcttt

SEQ ID NO: 11947 - DNA, 48 bp, Artificial Sequence
  Amplification primer (reverse)
ggggaccactttgtacaagaaagctgggttttttgtcttaaacgttct

SEQ ID NO: 11948 - DNA, 50 bp, Artificial Sequence
  Amplification primer (reverse)
ggggaccactttgtacaagaaagctgggtttttagatagtctagccattt

SEQ ID NO: 11949 - DNA, 46 bp, Artificial Sequence
  Amplification primer (reverse)
ggggaccactttgtacaagaaagctgggttacggcttggggcagag

SEQ ID NO: 11950 - DNA, 46 bp, Artificial Sequence
  Amplification primer (reverse)
ggggaccactttgtacaagaaagctgggtttaccattatccgtgct

SEQ ID NO: 11951 - DNA, 50 bp, Artificial Sequence
  Amplification primer (reverse)
ggggaccactttgtacaagaaagctgggttactattaaactccaatgtta

SEQ ID NO: 11952 - DNA, 46 bp, Artificial Sequence
  Amplification primer (reverse)
ggggaccactttgtacaagaaagctgggttgcgcattgtaacaaat

SEQ ID NO: 11953 - DNA, 47 bp, Artificial Sequence
  Amplification primer (reverse)
ggggaccactttgtacaagaaagctgggttttttggtaaaaggtctg

SEQ ID NO: 11954 - DNA, 46 bp, Artificial Sequence
  Amplification primer (reverse)
ggggaccactttgtacaagaaagctgggtttcctggaaagttcatc

SEQ ID NO: 11955 - DNA, 49 bp, Artificial Sequence
  Amplification primer (reverse)
ggggaccactttgtacaagaaagctgggtttagtttatctaaagcgttc

SEQ ID NO: 11956 - DNA, 50 bp, Artificial Sequence
  Amplification primer (reverse)
ggggaccactttgtacaagaaagctgggtttttatgtatagaaacagcag

SEQ ID NO: 11957 - DNA, 52 bp, Artificial Sequence
  Amplification primer (reverse)
ggggaccactttgtacaagaaagctgggttaatgtacataacaatagagagc

SEQ ID NO: 11958 - DNA, 46 bp, Artificial Sequence
  Amplification primer (reverse)
ggggaccactttgtacaagaaagctgggttcaacgatcccaagaac

SEQ ID NO: 11959 - DNA, 46 bp, Artificial Sequence
  Amplification primer (reverse)
ggggaccactttgtacaagaaagctgggttgccattcttacctcct

SEQ ID NO: 11960 - DNA, 46 bp, Artificial Sequence
  Amplification primer (reverse)
ggggaccactttgtacaagaaagctgggttacgttttttctgaccg

SEQ ID NO: 11961 - DNA, 52 bp, Artificial Sequence
  Amplification primer (reverse)
ggggaccactttgtacaagaaagctgggtttataaaataaatttgaagatct

SEQ ID NO: 11962 - DNA, 48 bp, Artificial Sequence
  Amplification primer (reverse)
ggggaccactttgtacaagaaagctgggttatcatcttgtaccaactc

SEQ ID NO: 11963 - DNA, 46 bp, Artificial Sequence
  Amplification primer (reverse)
ggggaccactttgtacaagaaagctgggttgccaataaattcacgg

SEQ ID NO: 11964 - DNA, 50 bp, Artificial Sequence
  Amplification primer (reverse)
ggggaccactttgtacaagaaagctgggttagtctgttttttaacaaaag

SEQ ID NO: 11965 - DNA, 49 bp, Artificial Sequence
  Amplification primer (reverse)
ggggaccactttgtacaagaaagctgggtttggttttagaacaacttta

SEQ ID NO: 11966 - DNA, 48 bp, Artificial Sequence
  Amplification primer (reverse)
ggggaccactttgtacaagaaagctgggttaattaagctgaaaatgac

SEQ ID NO: 11967 - DNA, 52 bp, Artificial Sequence
  Amplification primer (reverse)
ggggaccactttgtacaagaaagctgggttattatattcttttaatttgtca

SEQ ID NO: 11968 - DNA, 46 bp, Artificial Sequence
  Amplification primer (reverse)
ggggaccactttgtacaagaaagctgggttcttacgacgtcctgga

SEQ ID NO: 11969 - DNA, 50 bp, Artificial Sequence
  Amplification primer (reverse)
ggggaccactttgtacaagaaagctgggttgtgtgtcatgactactgtac

SEQ ID NO: 11970 - DNA, 46 bp, Artificial Sequence
  Amplification primer (reverse)
ggggaccactttgtacaagaaagctgggtttgagtagagcacaagc

SEQ ID NO: 11971 - DNA, 47 bp, Artificial Sequence
  Amplification primer (reverse)
ggggaccactttgtacaagaaagctgggttgaaacgaatacgttctt

SEQ ID NO: 11972 - DNA, 48 bp, Artificial Sequence
  Amplification primer (reverse)
ggggaccactttgtacaagaaagctgggttactacctaccgttttcac

SEQ ID NO: 11973 - DNA, 47 bp, Artificial Sequence
  Amplification primer (reverse)
ggggaccactttgtacaagaaagctgggtttttgatggtaacagtcg

SEQ ID NO: 11974 - DNA, 46 bp, Artificial Sequence
  Amplification primer (reverse)
ggggaccactttgtacaagaaagctgggttagaaaggcgctcttct

SEQ ID NO: 11975 - DNA, 49 bp, Artificial Sequence
  Amplification primer (reverse)
ggggaccactttgtacaagaaagctgggtttatctttaataaagcccta

SEQ ID NO: 11976 - DNA, 47 bp, Artificial Sequence
  Amplification primer (reverse)
ggggaccactttgtacaagaaagctgggttcatcccataaatttgtt

SEQ ID NO: 11977 - DNA, 48 bp, Artificial Sequence
  Amplification primer (reverse)
ggggaccactttgtacaagaaagctgggttcaagacatttcttaaagc

SEQ ID NO: 11978 - DNA, 46 bp, Artificial Sequence
  Amplification primer (reverse)
ggggaccactttgtacaagaaagctgggttttttgttttagcgatg

SEQ ID NO: 11979 - DNA, 46 bp, Artificial Sequence
  Amplification primer (reverse)
ggggaccactttgtacaagaaagctgggttttttaaaccatgctgt

SEQ ID NO: 11980 - DNA, 48 bp, Artificial Sequence
  Amplification primer (reverse)
ggggaccactttgtacaagaaagctgggtttttgtaaagaccttcttt

SEQ ID NO: 11981 - DNA, 48 bp, Artificial Sequence
  Amplification primer (reverse)
ggggaccactttgtacaagaaagctgggttttcctcgtttattaattt

SEQ ID NO: 11982 - DNA, 46 bp, Artificial Sequence
  Amplification primer (reverse)
ggggaccactttgtacaagaaagctgggttaaagaaaagatgtgcc

SEQ ID NO: 11983 - DNA, 46 bp, Artificial Sequence
  Amplification primer (reverse)
ggggaccactttgtacaagaaagctgggttctgtgcaggctcaaat

SEQ ID NO: 11984 - DNA, 49 bp, Artificial Sequence
  Amplification primer (reverse)
ggggaccactttgtacaagaaagctgggttaattgtccagtctaagtta

SEQ ID NO: 11985 - DNA, 50 bp, Artificial Sequence
  Amplification primer (reverse)
ggggaccactttgtacaagaaagctgggttatttagtgttatttctcctg

SEQ ID NO: 11986 - DNA, 49 bp, Artificial Sequence
  Amplification primer (reverse)
ggggaccactttgtacaagaaagctgggttttttttaagtgatgatgaa

SEQ ID NO: 11987 - DNA, 47 bp, Artificial Sequence; identical to SEQ ID NO: 11801
  Amplification primer (reverse)

SEQ ID NO: 11988 - DNA, 47 bp, Artificial Sequence
  Amplification primer (reverse)
ggggaccactttgtacaagaaagctgggttttttggggttactttac

SEQ ID NO: 11989 - DNA, 48 bp, Artificial Sequence
  Amplification primer (reverse)
ggggaccactttgtacaagaaagctgggttttttgctgaaataatgtt

SEQ ID NO: 11990 - DNA, 46 bp, Artificial Sequence
  Amplification primer (reverse)
ggggaccactttgtacaagaaagctgggttatcatacgaatgcaac

SEQ ID NO: 11991 - DNA, 49 bp, Artificial Sequence
  Amplification primer (reverse)
ggggaccactttgtacaagaaagctgggtttttttcatattttttcaaa

SEQ ID NO: 11992 - DNA, 50 bp, Artificial Sequence
  Amplification primer (reverse)
ggggaccactttgtacaagaaagctgggttattatttttataagcatgtg

SEQ ID NO: 11993 - DNA, 48 bp, Artificial Sequence; identical to SEQ ID NO: 11799
  Amplification primer (reverse)

SEQ ID NO: 11994 - DNA, 48 bp, Artificial Sequence
  Amplification primer (reverse)
ggggaccactttgtacaagaaagctgggttgataagcactttccttaa

SEQ ID NO: 11995 - DNA, 46 bp, Artificial Sequence
  Amplification primer (reverse)
ggggaccactttgtacaagaaagctgggttgcctaaaaaccaatca

SEQ ID NO: 11996 - DNA, 46 bp, Artificial Sequence; identical to SEQ ID NO: 11640
  Amplification primer (reverse)

SEQ ID NO: 11997 - DNA, 48 bp, Artificial Sequence; identical to SEQ ID NO: 11802
  Amplification primer (reverse)

SEQ ID NO: 11998 - DNA, 50 bp, Artificial Sequence; identical to SEQ ID NO: 11650
  Amplification primer (reverse)

SEQ ID NO: 11999 - DNA, 47 bp, Artificial Sequence
  Amplification primer (reverse)
ggggaccactttgtacaagaaagctgggttggctttaaagttcgata

SEQ ID NO: 12000 - DNA, 49 bp, Artificial Sequence; identical to SEQ ID NO: 11548
  Amplification primer (reverse)

SEQ ID NO: 12001 - DNA, 47 bp, Artificial Sequence
  Amplification primer (reverse)
ggggaccactttgtacaagaaagctgggttatgtttatggcttgctt

SEQ ID NO: 12002 - DNA, 48 bp, Artificial Sequence; identical to SEQ ID NO: 11802
  Amplification primer (reverse)

SEQ ID NO: 12003 - DNA, 49 bp, Artificial Sequence
  Amplification primer (reverse)
ggggaccactttgtacaagaaagctgggttgagttgtctttttttgtct

SEQ ID NO: 12004 - DNA, 46 bp, Artificial Sequence
  Amplification primer (reverse)
ggggaccactttgtacaagaaagctgggttttcaacttgattgcca

SEQ ID NO: 12005 - DNA, 45 bp, Artificial Sequence
  Amplification primer (reverse)
ggggaccactttgtacaagaaagctgggttttttgcaatttttgc

SEQ ID NO: 12006 - DNA, 47 bp, Artificial Sequence
  Amplification primer (reverse)
ggggaccactttgtacaagaaagctgggttttttaatgctgtttgaa

SEQ ID NO: 12007 - DNA, 47 bp, Artificial Sequence
  Amplification primer (reverse)
ggggaccactttgtacaagaaagctgggttttttttagctaaggctg

SEQ ID NO: 12008 - DNA, 47 bp, Artificial Sequence
  Amplification primer (reverse)
ggggaccactttgtacaagaaagctgggttttttgctaaaccttctg

SEQ ID NO: 12009 - DNA, 49 bp, Artificial Sequence
  Amplification primer (reverse)
ggggaccactttgtacaagaaagctgggttattcatattaacacgatgc

SEQ ID NO: 12010 - DNA, 46 bp, Artificial Sequence
  Amplification primer (reverse)
ggggaccactttgtacaagaaagctgggtttttgcgttttggaggg

SEQ ID NO: 12011 - DNA, 46 bp, Artificial Sequence
  Amplification primer (reverse)
ggggaccactttgtacaagaaagctgggtttgcaccttgatggcga

SEQ ID NO: 12012 - DNA, 48 bp, Artificial Sequence
  Amplification primer (reverse)
ggggaccactttgtacaagaaagctgggttccataatatttgatgctg

SEQ ID NO: 12013 - DNA, 48 bp, Artificial Sequence
  Amplification primer (reverse)
ggggaccactttgtacaagaaagctgggttttctaatcctacagcatg

SEQ ID NO: 12014 - DNA, 50 bp, Artificial Sequence
  Amplification primer (reverse)
ggggaccactttgtacaagaaagctgggttaaaaattcctcctaaattaa

SEQ ID NO: 12015 - DNA, 53 bp, Artificial Sequence
  Amplification primer (reverse)
ggggaccactttgtacaagaaagctgggttaaagttttgactattactgatag

SEQ ID NO: 12016 - DNA, 47 bp, Artificial Sequence
  Amplification primer (reverse)
ggggaccactttgtacaagaaagctgggtttgggggagatagttatg

SEQ ID NO: 12017 - DNA, 48 bp, Artificial Sequence
  Amplification primer (reverse)
ggggaccactttgtacaagaaagctgggttttgacagaaagctaattg

SEQ ID NO: 12018 - DNA, 7361 bp, Streptococcus agalactiae
ctttgatacaatattatcaaaattatattaacggtaaagatattgttaaagaccaaacttggattatcaatcgttatcaagaaattattagtgatttgtctttaggaagcactattgcagaagaaattactcgctctatagagcagctagcttcacttcccatagaaaataatcagtttttatatgattgttttttagcagccggtgaagataacaacgcaaagttagttgcaacgttttttaatcaaaatgacattcctgcaagatatgttcatccaaacgaagcaggaattattgtaactaaagaaccatgtaatgcacgaattattccaggaagttatgataagattgagaacttatgtctatacaatgaggttcttgttatccctggattttttggagtcacagaagataaccaaatttgtaccttttcaagagggggatctgacattactggatccctaattgcagcaggcataaaagcagacctttatgagaacttcacagatgttgatggtatatttgcagcacatccaggtgtagttaagaaccctcacgctatccctgagcttacttataaagaaatgcgtgaattagcctatgcgggtttttcggttttacatgatgaagctttacttcctgcctatcgtggcagaatccctcttgttattaaaaatacaaataatccccaacagcctggtacaaaaatagttttaaagcatactcgtagtaacatagcagtaactgggatcgcttctgatagccgttttgctagcataaacgtatctaaatacttaatgaatagagaagtaggtttcggccgaaaagtactacaaattttagaggatttaaatattagttttgaacatatgccaactggcatagatgatctatccattgtcttacgtgaaaaagaattgacaccaatcaaagaacaagaaatcttaaattacctaactcgtaaactagaagtagattacgttgacatccaacacaatctatctacaatcgtaattgtaggtgaaaatatgaaaagtcagattggagtcactgcaacagcgacacaagccttatcaagagaaaaaatcaatatcaccatgatatcacaaggttcaagcgaagtctccattatgttcgttataaacagtaaggatgaaaaaagagctattaaagcactatatgaaacattcttccaaaaatagtacctattacactacttacactattagatagataacaaatcgtcctaagtaagcttacttaggacgattttatttagaacataggatagtttttccacttttaatcgtaaccacttggtatcagtgacaaattcggacaattaagatgttagccaatcttaaggataataattccaataaaaaaaggctaaccaaagttagtctccctttatctactccgccagtaggactcgaacctacgacatcatgattaacagtcatgcgctactaccaactgagctatggcggattatagctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgttttttgtcattgacggatttacaatgtaaatccaccctgcacattcgttcatcttgttcagttttcaaaggtctttgcctctcttgagacaacttctatattctagcaaacttattctgctttgtcaactactttttttaagttgtttataaaatgataatacaatattaggttcgcttaagaactcatttagtatactataattttttatttgttgtcaataggttttaaaaaaatctcagagaaaaccctgagattttttaaattatgttacaaagttaatttcctttagcttcaattaaacctagttcgccatcttcacgcttgtaaaggacatttgtcgtattatcttctgcatctgtatagataaagaaatcatgacctaaaagttccatttgcaacaatgcttcctcaacatccattggttttagattaacattcttagtacgtacaattctttggcttactgcttcttcatctggctcagcctcaaattctgttgtgaaaacttgacttgctggaatcttttcacgatattttttcgcaattttagttttatttttacgaatttgacgctcaattttatcaacaactaagtcaattgacccatacatatcttgtgaaacatcttctgctcgtaaagtaatagaatctattaagattgttacttcaacttttgcggtcttctctctgtatactttgaggttgactctagtatctaattcttgtgcttcattaaagtatttttcaactttagagagtttggtctcaacatactcacgaatagcttctgttacttcgatgttttcaccacgaatactgtatttaatcatatgagtacctctttcttgcgttgttaacgctttctatactcttattataaccgctttcatgaaaa

SEQ ID NO: 12019 - DNA, 8172 bp, Streptococcus agalactiae
tccaatcatacttaatttcactaatatctggattttgacatattcagttaattctttttcatgctttttgagataagctacttgttctttttttattacttttttacctttctttactgctgactgtttgctattttttacttcgtttgactgacttttagattcactattcatttgacagcctgctagtaacatcccaataatagatatgggaattaaccattttacatattttttcaacatgctctcttttcttagaaaataaacttcccatgtcaagtatctaataaaaataattattatttaccagtatgttaaaactaatattagtataacaaattttcacgagtttaattttttagtcgtaacatatacactgaaaaatcttattattttatactacctatctatcattcacaaacacttttattacttcagaacctatgacatttaggagtcctctttgaatttcatttaaatgttgagtctccactaactcttgaaaaatttccttattatttctgcttgttttaaaccttctataacgattgcaataatgaaaaacaaatataagtaattttcagtaactttttctcaaaattaccagcacaatacaaaaaagacaaggcttctaaaccttgtctttataaatataccggcggccggggtcgaaccggcacgtccgtgaggacactggattttgagtccagcgcgtctgccaattccgccacgccggctatcttaaaactggggtagctggattcgaaccaacgcatgagggagtcaaagtcccttgccttaccgcttggctataccccatgaaaaggcgagtgatgggaatcgaacccacgaatgtcagagccacaatctgatgtgttaaccacttcaccacacccgccatattagaaaaaacacgggcagtaggaatcgaacccacactgaaggttttggagaccttagttctacctttaaactatgcccgtttactatggagagagagggattcgaacccccgaacccgaaggagcggatttacagtccgccgcgtttagcctcttcgctatctctcctaaggtataaatggcgcgagacggaatcgaaccgccgacacatggagcttcaatccattgctctaccaactgagctaccgagcctattgcgggagcaggatttgaacctacgaccttcgggttatgagcccgacgagctacctagctgctccatcccgcgatatctttaaaggaggatgtgggattcgaacccacgcacgcttttacacgcctgacggttttcaagaccgttcccttcagccggacttgggtaatcctccatataacaaaaaatagtccgtacgggattcgaacccgtgttaccgccgtgaaaaggcggtgtcttaaccccttgaccaacggaccatattcttgatgggcacgagtggactcgaaccaccgacctcacgcttatcaggcgtgcgctctaaccacctgagctacgcgcccaaaataacttctaaaattataaagttaatgccggctacatgacttgaacacgcgaccctctgattacaaatcagatgctctaccaactgagctaagccggcaatctactaatgcgggtgaagggacttgaacccccacgccgttaagcgccagatcctaaatctggtgcgtctgccaattccgccacacccgcatttctaaatgacccgtactgggctcgaaccagtgacccattgattaaaagtcaattgctctaccaactgagctaacgagtctacggtcccgacgggaatcgaacccgcgatcttcgccgtgacagggcgacgtgataaccgctacactacgggacctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgttttttgtcattgacggatttacaatgtaaatccaccctgcacattcgttcgtcttgttcagttttcaaaggtctttgcctctcttgagacaacttctatattctagcaaacttattctgctttgtcaactactttttttaagttgttaactacgcgctaatagaaactgctctctcgagacaacttattcattatactaaatatttctacttcctgtcaatactatttttgtattttataaatttagtatagacataactattcctctatattcaattaagagaaattatataaccactattgagaaatgtagtctagcgattaaattctttgctcatcgaaaatatccaataaatataataatgcataaaacgcctgcttacgaaatataaacaaaattgtttgcatttcgtaaacaagcgttacctatttaacaatatatgatgagtgttcccgctgagaataattctcagcggtagaccagagctagactaagaatcgattgattccatcatcataacactcaacaaaattgataaaaattatactaattcaataattgccattggggcagcatcgccacggcgtggttctgttttaagaatacgagtgtatcctccgttacgttcagcataacgaggtgcgatgtcgtcaaaaagtttttgaagagctgttgttgatgtatatttatcagaagcttcatcatagttttctgatgcaatttcattacgtacataagcagcagcttgacgacgagcatgtaaatcaccacgtttacctagagtaatcattttttcaactgttttacggatttctttagcacgtgcttcagtagttacaattgattcgttgataagaagatcggttgtcaaatcacgaagcattgccttacgttgtgagctagtgcgtcctagtttacggtaagccattatgtcctcctattttatttatcgttttttaatccaagacctagatcggcaagtttgattttaacttcttcaagactcttacgtcctaagtttcggactttcatcatttcaggctcagttttttctgttaaatcaaatactgtattaattccagcacgttttaaacagttatatgagcgcactgacaaatcaagttcctcaattgtccggtcaagcactttctcatcgttcactttctctgtttccttcattacttcagttgctttagcaacctctgttaaatcagtaaacaagtttaagtgttcaattaagacgcgagctgaaagaccaagagcatcctcaggaatga

SEQ ID NO: 12020 - DNA, 7267 bp, Streptococcus agalactiae
atcaaaaaaacatgaccagtatgaattaaagcaacgtataatcaatgccttaatgcgtaaaggataccagtacgaagatatcaaaagtgctttaagagaatatttataagataataactctcagacgatgtattttacagaaaattatgataaactataacagacgtataaattgtagaaagttggtaggctatgagattacctaaagaaggcgactttattacaattcaaagttacaaacatgatggtagtttacaccgaacttggcgtgacaccatggtattaaaaacaaccgaaaatgccctcattggtgttaatgatcatactttagtaacagaaaatgatggtcgacgctgggtgacacgagagcctgcaatagtatactttcataaaaaatactggtttaacattatcgctatgatacgtgaaactggtgtctcctactattgtaatctagcaagtccgtatatcttggaccctgaagcactcaagtatattgactatgaccttgatgtcaaagtatttgcagatggtgaaaaaagactactagatgtggacgaatatgaacagcataaagytcagatgaactatcctaccgatattgattatatattaaaggaaaatgtaaaaatattggtagaatggataaatgagaataaaggccccttttcatcatcatatatcaatatctggtataaacggtaccttgaattgaaaaagcgctaactaacacactaaatagtgtgtttttattaatatcaaatttaattacaatactattgcaaaaatatatacttaaaataaaaaaagtagaaagatcactttctacttttttaagaatagtccgtacgggattcgaacccgtgttaccgccgtgaaaaggcggtgtcttaaccccttgaccaacggaccatattcttgatgggcacgagtggactcgaaccaccgacctcacgcttatcaggcgtgcgctctaaccacctgagctacgcgcccaagctattgcttggtttttactttcttataaagtaaagcgggtgacgagaatcgaactcgcgacaacagcttggaaggctgtagttttaccactaaactacacccgcttctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgtttttttgtcattgacggatttacaatgtaaatccaccctgcacattcgttcgtcttgttcagttttcaaaggtctttgcctctcttgagacaacttctatattctagcaaacttattctgctttgtcaactactttttttaagttgttaactacgcgctaatagaaactgctctctcgagacaacttatttagtttactacatcatctcttactttgtcaactcttttttcatactttttctacattttctgaaaatgtagatagagcgcaagaaaaaaagaggtctcacctctttttatttcttagtaactactacaaatctattaggatcgttaccttcagaataactttcaacaccctctatagttgcaattgttttatgaacagtttttcgctcactgttactcataggatccatatggtaaggttcattagtctctaaaacacgcctagctatttttttagaaaaatcaattaaagtttctgtacgatgctcaacgtagtcatggacattaatggatactgaaaaactcttagaaaagcggtcatgaagataattttgtgctaacaactgcaacgattttaatacttttccatgataaccaatgatgcgcccagcttctggcgtttctatttggagatttatttgtcgcttacttgtcgtagtttctattgttgcatctaaatccatctcatagatgatattttcaacgtatttagtcacctgagcagctgctacttcaatattaggaagtaggtcaattttttcaatagcttcacttgtagttacaacgtttttatcatcaatttttggaagttctggttgtgatacgtcttctttttcaagcgtttcatcaacctcctctatatattcttccaccacatctacgctagacggtacattcttaatattttttaacgctaccgattcattaatatcagttacttcgtcggtgataccttctatttcaacttttgctggctttttaccaaagcccaaaaaaccttttttctcacgtgatacaacttttatatgtgccctcaatcgtgaaatgtttaactcttgtagtcctttttcaatagcttcttctacagtcgctcctgtaaataatacc

SEQ ID NO: 12021 - DNA, 8766 bp, Streptococcus agalactiae
agtacccgtatatttactaggaacaatgacatttactttcccgaattggtctttctatggcttttcacgattaagcatactaactatatcaaagggattgacatagtaggtaacatgcttcccagcttcttggatttttttagcagaaatgccttccattttttccaagcttcttgatacatcagggccatcgaaaaggactacttgaccaacattctccaattctgcatagctaagattaacaactgcttgagaagatacaatcgtaccgagtgagtgaccagtaacatctataatagctccaggcgcttttccttttagctcggcaattttttctttcatagccttattagccaatttcgcttgtggaatatacttgttagagacagcaaacattgcattgttactaacccaatcgtttagtgtatctagaccaatcccatcactaccacgaatggctagataagtgtgctttgtagtgctatctattttttcagtatctgacaggtagtaagcattaaaacctgccttatcgtcagtaagcacacctttttgataagaatgagtaacataatgctcagtgtgatagcctccattgacatctggaatgaggacctttacattttcatcaatagattttaaggacttatctggttgcaggtagacaataccatcattggggaggttagtgccaccctgtgtgatttgacctttgttatcttctgagggttgagaaaattttacttctgttactgagtcagtctcaaataattcaggaaatgaattaggtcgactattatatgcactttctgctaaagagctatgtaagttatcaaaattatctaagttccaattactcaattattcttctcctctaccttgcttgtggtaaaaattctattactttatataggatgattcaagctattcataaatgtgccaaataccatttttatgtatatacggcttatttagcattcccattgatttgatatttgggatatcatttttatgagctaaataaaaatcaactattaattttgaattttgtagatgattaaactttcctctcagtgaaagattataatcacccccttgtggagttccattcccgctttgttctacttttacacttgaccaatcgaattgaacggactcaatttggttgttatgtaattttacataatctatgatttcttgctcatgctctttgagataggctaattgttctttttttgtcatttttttatctttcttcacttctgattgcttgctattttttacttcgtttgactgaattttatgttcactattcatttgacagcctccaagtatcatcccaaaaattgatatgggaattaaccattttatatattttctcatcatgttctcttttcttagaatataaattttatatatcaagtatataatgaaattaactattattcaccaacattataaaattaattttagtataacaaaattttcacgtatttttatagttttagtcttaacatgtaaacagaaaatcatttgtatattttaaatgccctaattaaattaataattaatatttattattatataaattcttctacaatgaaaaaaataaatatatattacaagtaacatttcacaataaattatctagtagaaaaaagacaaggtttagaaaccttgtctttataagtataccggcggccggggtcgaaccggcacgtccgtgaggacactggattttgagtccagcgcgtctgccaattccgccacgccggctatcttaaaactggggtagctggattcgaaccaacgcatgagggagtcaaagtcccttgccttaccgcttggctataccccatgaaaaggcgagtgatgggaatcgaacccacgaatgtcagagccacaatctgatgtgttaaccacttcaccacacccgccatattagaaaaaacacgggcagtaggaatcgaacccacactgaaggttttggagaccttagttctacctttaaactatgcccgtttactatggagagagagggattcgaacccccgaacccgaaggagcggatttacagtccgccgcgtttagcctcttcgctatctctcctaaggtataaatggcgcgagacggaatcgaaccgccgacacatggagcttcaatccattgctctaccaactgagctaccgagcctattgcgggagcaggatttgaacctacgaccttcgggttatgagcccgacgagctacctagctgctccatcccgcgatatctttaaaggaggatgtgggattcgaacccacgcacgcttttacacgcctgacggttttcaagaccgttcccttcagccggacttgggtaatcctccatataacaaaaaatagtccgtacgggattcgaacccgtgttaccgccgtgaaaaggcggtgtcttaaccccttgaccaacggaccatattcttgatgggcacgagtggactcgaaccaccgacctcacgcttatcaggcgtgcgctctaaccacctgagctacgcgcccaagctattgcttggtttttactttcttataaagtaaagcgggtgacgagaatcgaactcgcgacaacagcttggaaggctgtagttttaccactaaactacacccgcttctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgtttttttgtcattgacggatttacaatgtaaatccaccctgcacattcgttcgtcttgttcagttttcaaaggtctttgcctctcttgagacaacttctatattctagcaaacttattctgctttgtcaactactttttttaagttgttaactacgcgctaatagaaactgctctctcgagacaacttatttagtttactacatcatctcttactttgtcaactcttttttcatactttttctacattttctgaaaatgtagatcaggctcaagcttaacgattctttttaaaatcattaaattttaaaacaaatttcagacatgttgccaaagttttgatattattactataatatagtttgtagaggagaataatatgggccaagaacctatcatcgaatatcaaaatatcaataaagtgtatggggaaaatgttgcggttgaagacattaaccttaaaatttaccctggtgattttgtttgtttcatcggtacgagtggatcaggtaaaacaacattaatgcgtatggttaaccatatgttaaaaccaacaaatggtactctattatttaagggaaaagatatttctactattaaccccattgaattaagacgcagaattggatatgttatccaaaacattggtttaatgcctcatatgaccatttacgaaaatatagttcttgtaccaaaattattgaaatggtcagaagaagctaaaagagctaaagcaagggaacttattaaattagttgaattacccgaagaatatttggatcgctaccctagtgagttgtctggcggtcagcaacaacgtatcggtgtcattcgcgctcttgcagcagaccaagatattattttaatggatgagccttttggagctctggatcctattactagagaaggtattcaagacttagtcaagtctcttcaggaagaaatggggaaaactatcatcttagttactcatgatatggatgaagccctcaagttagcaacaaaaattattgttatggacaatggtaaaatggtccaagaagggacacccaatgatctcttacatcatcctgcta

SEQ ID NO: 12022 - DNA, 8064 bp, Streptococcus agalactiae
cttctttgttttctttagagatattaactgtacccactttgggcgttaaaatacctaaagtagcctttattaaagttgatttagcagccccattttcacctgttaaggtaacaaactccccactgtctaaatggtaattaaccccttccagcacaggatcgctatcgtactgaaaagtaagaccactaactgtaatatatcgcatgattacccttctaattctctagagaaaagatcaagaaaacgttctaaaacgaccttttcgtcctttgaaaaatgatttactaatcttccgtaaacccctaacgtattgtcatgatgatgtgtgtgttcatctgcaatgggtttagcaagttcagataactcaaaataagtaatacgagcatctttagaatctttattcgctttcaacatatcctgagaaattaaactttttactgctttagttacagctgcctgactaatatttaacttcttagctaaatcagaatttgtcaactgctcttgtgataaaagcatcagaatgtgttcttgcgtattagtcaatttaacatcactttgacaagtaccaaacaataattcatgttgattttctgctttaagcaagatttgactcactaaatggtctaatttttgttctaaaactgtcatatatacctcttttttgttaaccagtaaattatatcacgaagatatagaagaatcaatcatagataggtgaagaagataaaaccttttatctcaacaacctaactttataaacttctttgcaaaaacctttcatactattaaaaacacgatcagcttttttctctgtagaacacattgaaaaaacagttggtccacttcctgtcattaatgcaacatcggctccagaatttaacatacgttcttttattgtacttataactggatttttagtaattgtaatatcctcgagtgaatttcccatagatttgaccattaactgataatctgatgacaaaatagcagactttaataaatcaatatcaactctacttatagacttacaatcaatatctctaaaaatggatttagttgaaataccaaaatccggcttaaccagaactatccaacatggtctcaatgtcggtaagggtttaacaatttcacctttacctaatactaacgaacatcccccaccaagacaataaggaacatcactaccaattttaaaaccaatagcaaccatttcgtcatagtccatttgaagattccataatcgattaagagctcttattgtagcagcagcatcagtagaaccaccccccagtcctgcacagacaggaatggatttttctaatctaatatgaacacctttattaataccatattgatttttgattatatctgcagctttaaacacatcattatcattatttaaaggcattttgctactatcagaatcgataacaatacaatcttcctttagctcagaaatggtaacgtagtcattaagatcaatactaaccataatcatagctaattcatgataaccatcgtcacatcgtcctttaatatctaatcctaaattaagtttggcaggagctttctcaaaaattttcataaaacctccctaataaaatatagaatatccatattataacataacaaatgacaaattcggacaattaagatgctagccaatcttaaggataataattccaataaaaaaaggctaaccaaagttagtctccctttatctactccgccagtaggactcgaacctacgacatcatgattaacagtcatgcgctactaccaactgagctatggcggattatagctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgttttttgtcattgacggatttacaatgtaaatccaccctgcacattcgttcgtcttgttcagttttcaaaggtctttgcctctcttgagacaacttctatattctagcaaacttattctgctttgtcaactactttttttaagttgttaactacgcgctaatagaaactgctctctcgagacaacttatttagtttactacatcatctcttactttgtcaactcttttttcatactttttctacattttctgaaaaaagtttcctgttggctaacaccaataacatagagtttaaaattccatacctaaatttattttattagtaaaaaaataaaagatgggctagccatcttttataatatttgttttttatattcttcagcttcttggggtgtagataaaacaaaatgaccaggggtaatctcgtgcatttgacgttcttgtccgtcttgctcaatagctggattatacggctggtgaacacgttgacgttcactctccggatctggttctggaatagctgataatagactcttcgtataagggtggattggattgttataaacatcatcagatgttccaacttctaacagtttcccccaatgcataacaccgatacgatctgaaatgtattttaccatagacaaatcatgtgcgataaacaaataagtcaatccttgttctctttgcaatttttgcattaaattaacaacttgtgcttggattgaaacatctaaggcagatattggttcatcagcaatgataaatttaggctctactgctaaagcacgtgcaatcccgatacgttgtcgttgtccacctgaaaattcatgcggataacgtgttaaatgatctttatttaaccctacaagatctaatagggcctgaactttactatcacgatctgattttgatttagctaatttatgtatatctaaaccttctgctacgatatcacgaatcttcatacggccgtttaagctagcctgaggatcctgaaaaatcatctgagcgtctttacgaaaactatgtaatgctttacctttcagatgtgagatcacttctccattaaaggtaatttctccatcagaaatatcataaagttttaaaattgaacgtccaacggttgtctttcctgatccagattccccaactaatccaaacacttcaccttcataaatgtcaaaactaacattatcaattgctctcacttcattagcttttcctttattgaaggtcaaagaaacatttttgacttcaactaatttttttcgattttcagtcattaggct

SEQ ID NO: 12023 - DNA, 7250 bp, Streptococcus agalactiae
tttcgagtcaaagtcatcagcgtttactgttacggcagcagttccaagagttactccactcacaaggactgctgataatattctttttttcatttttattaaactactcctttacgataagacattaaatattttaccaaaaaattcacgaaattatattacgtcattgttacatttatatttgaaatcaactatttctaaatgaaccataatcaaatctagaaaacgataaccttcttctattcactctatcaatataattactccatagtgaaactaaaagagaaataaaaaaagagtataattactcttaaaattataatatttacggagaataagggattcgaacccttgcgccagttacccgacctaacgatttagcaaaccgtcctcttcagcctcttgagtaattctccaaattaatattaatgggcacgagtggactcgaaccaccgacctcacgcttatcaggcgtgcgctctaaccacctgagctacgcgcccaagcaaatgcttggttttacttttatgtaaagtaagcgggtgacgagaatcgaactcgcgacaacagcttggaaggctgtagttttaccactaaactacacccgctaaaaacttatataataaatggcgcgagacggaatcgaaccgccgacacatggagcttcaatccattgctctaccaactgagctaccgagcctattgcgggagcaggatttgaacctacgaccttcgggttatgagcccgacgagctacctagctgctccatcccgcgatatctttaaaggaggatgtgggattcgaacccacgcacgcttttacacgcctgacggttttcaagaccgttcccttcagccggacttgggtaatcctccatataacaaaaaatatggaccttgtaggactcgaacctacgaccgctcggttatgagccgagtgctctaaccagttgagctaaaggtccaaagtctcaataaaataaatagcggcggaggggatcgaacccccgacctcccgggtatgaaccggacgctctagccagctgagctacaccgccataaaaatatatccatcgggaagacaggattcgaacctgcgacaccttggtcccaaaccaagtactctaccaagctgagctacttcccgaaaaatatgcaccctagaggagtcgaacctctaaccgcctgattcgtagtcaggtactctatccagttgagctaagggtgctaaatattatatgccgaggaccggaatcgaaccggtacgatgtttaccatcgcaggattttaagtcctgtgcgtctgccagttccgccaccccggcctctaacaagcgaacgacggggttcgaacccgcgaccctcaccttggcaaggtgatgttctaccactgaactacgttcgcactaaagacactatttatcctataaaattgtaatgccggctacatgacttgaacacgcgaccctctgattacaaatcagatgctctaccaactgagctaagccggcaatctactaatgcgggtgaagggacttgaacccccacgccgttaagcgccagatcctaaatctggtgcgtctgccaattccgccacacccgcatttctaaatgacccgtactgggctcgaaccagtgacccattgattaaaagtcaattgctctaccaactgagctaacgagtctacggtcccgacgggaatcgaacccgcgatcttcgccgtgacagggcgacgtgataaccgctacactacgggacctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgttttttgtcattgacggatttacaatgtaaatccaccctgcacattcgttcgtcttgttcagttttcaaaggtctaatgatatatcataaaaatatatccatcgggaagacaggattcgaacctgcgacaccttggtcccaaaccaagtactctaccaagctgagctacttcccgaaaaatatgcaccctagaggagtcgaacctctaaccgcctgattcgtagtcaggtactctatccagttgagctaagggtgctaaatattatatgccgaggaccggaatcgaaccggtacgatgtttaccatcgcaggattttaagtcctgtgcgtctgccagttccgccaccccggcctctaacaagcgaacgacggggttcgaacccgcgaccctcaccttggcaaggtgatgttctaccactgaactacgttcgcactaaagacactatt

SEQ ID NO: 12024 - DNA, 9042 bp, Streptococcus agalactiae
tatcctataaaattgtaatgccggctacatgacttgaacacgcgaccctctgattacaaatcagatgctctaccaactgagctaagccggcaatctactaatgcgggtgaagggacttgaacccccacgccgttaagcgccagatcctaaatctggtgcgtctgccaattccgccacacccgcatttctaaatgacccgtactgggctcgaaccagtgacccattgattaaaagtcaattgctctaccaactgagctaacgagtctacggtcccgacgggaatcgaacccgcgatcttcgccgtgacagggcgacgtgataaccgctacactacgggacctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgtttttttgtcattgacggatttacaatgtaaatccaccctgcacattcgttcgtcttgttcagttttcaaaggtctttgcctctcttgagacaacttctatattctagcaaacttattctgctttgtcaactacttttttttaagttgttaactacgcgttactagaagctgctctctcgagacaacttattcattatactaaatatttctacttcctgtcaatactatttttgcattttttcttttatttttaaaaagttaatattatttatagtaactaaccttctatacttgttgaatggatagcatttttaccgttgtcatgttcatatttcatcttcttaattcacaaatttaaacttcatcttcataaaaaatacccttcaaattttatctaaatttgaagggtatttgaaatttataaagttctttaaaaatatatgatgacttattttttatcttcttcttgcattttttctttgatttcatcgtatgataacgctcttgctttatcttcatcattttctgtctcaggcattttacctgtctcaaaaatcgatttaatctgagcagcatcaagagtctcatattttaagagggcttctgcaattaatttatgagtatcacggttttcgttgataatatcagctgccttattacgtgcttcattaagaaggtgacgaacttcatcatcaataagttgtgcagtttgagcagaatatgatttttcaggtgacatttgaccagccatcattgcgtggttgccttcgtattgaactggtccaagtttctcgctcataccatattcagttaccatagcgcgggccatagcagtggcttgttcgaagtcatttgaggcacctgttgtctgagcgttgaaaataatttcttccgctacacgtcctcccataagacctgctaattgctctttcatatcatcttttgaaagaagcatttgatcttctttaggtaaagcaatcatatatccacctgcacgaccacgtggtacgatagtaactttatgaacaactcgcgcatttgaaagaatcaaaccgacaattgtgtgcccagcttcatggtaagcaaccatagctctttctctttcagaaatagtacgatcttttttagaaggaccagcaattacacggtcttctgcttcatcaatatctgaagcatcaataacttttttatttcgtcgcgcagcaactaaagcagcttcattgagaacattctccaaatcagcaccaacaaatcctggggtttgttgagctactacttttaagtcaacattatctgctaatggtttatttttagcatgtactctcagaattgcttcacgaccttttacatcaggttgtccaactagaacttttctatcaaaacgtcctggacgcagtaatgcgggatctaacacatcactacggttggtagcagcgataacgataatactttcgtttccttcaaaaccatccatttcaattaaaagttggttgagcgtttgttcacgttcatcgtttccgccacccataccagctccacgtcgacgtccaacagcatcaatttcatcaatgaaaataatagcacgttcagcttttttagcatcttcaaacaaagagcgtactcgactagctccaacaccgacaaacatttcaacaaaatctgaaccggaaatactaaagaatggaacccctgcttcaccggcaacagcttttgctaatagggttttacctgtccctggaggtccttctaatagaacccctgctggaattcgggcacctagagatttatatcgtttaggatctttaaggaagtcaacgacttctattaattcttgcttttcttcctctgctccagcaacatccgaaaatcgaactttaacctcatctttactagatgatcttgctttatttttaccaaagctcatggcaccacgagcgccaccgccaccgccttggttcatcatcatcatgaagaaaccaatcatgataactaaaggtaaaaaactggcaatataagaaatccatgtcccacttgaactttcatgtttgacctgaatattagtgttattttcttcagcagcgctaacaagagattttattgaagagtcatttggtagtataacagaattaaatcctgtaactttagtagcaacactaccacctaaaaaagtaaaactattagctgatttaattgttttggctttcttatatgtcccactaacttcaacaacaccaccacttggctggtatgagatagacttaatttctccagcttttaattgtttaacaagttttgtataagaaatttgctggttttgagagctagttccttttaaatagtattgaaaggttgtaataaccgcaataatcaataatatgtaaataaaggaatttttcagaaaaccattatttttattatttttcatagtttaagagagtaccttttttctattttgagtaaatttcttcttttaacacaccaacataaggtaagttacgatagttttcagcatagtctaaaccgaatcccacaataaattcatttgggatatcgtaacaaacgtaatcagcatcaatatctaccaatcgcccttctggcttatcaaaaagggttgcaactttgacagagttagcttggcgatacttaaacatatctcgaaggtattttaatgtacgtccagtatcaatgatgtcttcaataaagattacatctcttccttcaatgttagtatcaacatcttttaaaattttaacttctccactactagttgtaccaccatgatagcttgaaacaaccataaaatcaatttcaacatgtgtatcaatatgctttaatagctcagccataaaaggcactgacccctttaatacacctactaataatggattcttacctgcataatctgcagttaatttagctcctaattctttcgttttcagaataatatcttcttctgaatataaaactttttttatatcattttcaagcatgatgtcaccttttttctaaattttcaatataaagtttgcccttcattatatcatgttcagaaggttttctcaaatatgttctacctgcaacaatcacaaatatcaactctttattttgctccccaataacagcttcttctctctcttttagagttattttctcatcaataaatagacggcgaatttttttagtgtgatttcctaaaaatatcctatccccttcttttcttcttcttaaaataatcggagaagtatcataaataggaatagtaatgtctgcttgagaaatgaattttccataggaaaataaatattgtgagaatatttgtatattatgcaattctaatcttttttcaaccttaaaactatccgtcttaggatggatttttgtaatatgaaaactctcgtaatccttatgaagaaaatagcccgatttaatagtatagtcaatattggctttagttctaatcaattttaatattactctgaactgttctttactcacttgtaaatctggaaatttgctaatgtaatcttgcaataaaaattcttggacagaatgagtttgccttaaaaaatcatagcagtttgttacttcgatgctccttgttaggtctgttaaagccgtgaataaacactctgtttcctcagagagagttatgagaga

SEQ ID NO: 12025 - protein, 507 aa, Lactobacillus leichmannii
MKSKLKSLITGLIMILPLLLLSFATPQKVSAADTNNSVKVTLHKRVFDSAQEAKQNTGEIMNDFGGTGLNGVTFKAYNVTDHYLSLRKSGDSAQDAVTAIQSDAKDSDNLPSYAGSAIATETTATSKGEDGIAAFDNLNLKDSDGNYQTYLFVETDSPTDVTQQAAPIVLTMPIYKTSDTSAINHDIQIYPKNVKSTPITKDLDEASKKDLAVTLPDGSTIYNAQYGKSFGYNITVNVPWNIKDKDTFNVVDKPDTGIDIDASTVSIDGLTKSTDYTVNKKDNGYQVVFKTTSAAVQALAGKSLTITYKATLTNNATPDKAIGNTATLSIGNGTNITSTPANGPRIYTGGAQFVKKDSQSNKTLAGAEFQLVKVDSNGNIVSYATQASDGSYTWNDSATEATTYTSDANGLVALKGLSYSDKLDSGESYALLEIQAPDGYAKLDSPVKFSITQGSFGDSNKITIDNTKEGLLPSTGGKGIYIFLAIGIVIMIVAFGGYKAIKKHEEI

SEQ ID NO: 12026 - protein, 344 aa, Streptococcus pyogenes
MKKNKLLLATAILATALGMASMSQNIKAETAGVIDGSTLVVKKTFPSYTDDNVLMPKADYSFKVEADDNAKGKTKDGLDIKPGVIDGLENTKTIRYSNSDKITAKEKSVNFEFANVKFPGVGVYRYTVAEVNGNKAGITYDSQQWTVDVYVVNKEGGGFEVKYIVSTEVGQSEKKPVLFKNSFDTTSLKIEKQVTGNTGEHQRLFSFTLLLTPNECFEKGQVVNILQGGETKKVVIGEEYSFTLKDKGSVTLSQLPVGIEYKLTEEDVTKDGYKTSATLKDGEQSSTYELGKDHKTDKSADEIVVTNKRDTQVPTGVVGTLAPFAVLSIVAIGGVIYITKRKKA
